US012655418B2

(12) United States Patent
Chan et al.

(10) Patent No.: US 12,655,418 B2
(45) Date of Patent: Jun. 16, 2026

(54) HAPLOTAGGING—HAPLOTYPE PHASING AND SINGLE-TUBE COMBINATORIAL BARCODING OF NUCLEIC ACID MOLECULES USING BEAD-IMMOBILIZED TN5 TRANSPOSASE

(71) Applicant: Max-Planck-Gesellschaft zur Förderung der Wissenschaften e.V., Munich (DE)

(72) Inventors: Yingguang Frank Chan, Tübingen (DE); Marek Kucka, Herrenberg (DE); Andreea Dreau, Toulouse (FR)

(73) Assignee: Max-Planck-Gesellschaft zur Förderung der Wissenschaften e.V., Munich (DE)

( * ) Notice: Subject to any disclaimer, the term of this patent is extended or adjusted under 35 U.S.C. 154(b) by 1221 days.

(21) Appl. No.: 17/430,530

(22) PCT Filed: Feb. 14, 2020

(86) PCT No.: PCT/EP2020/053948
§ 371 (c)(1),
(2) Date: Aug. 12, 2021

(87) PCT Pub. No.: WO2020/165433
PCT Pub. Date: Aug. 20, 2020

(65) Prior Publication Data
US 2022/0127597 A1    Apr. 28, 2022

(30) Foreign Application Priority Data

Feb. 14, 2019    (EP) ..................................... 19157290
Apr. 17, 2019    (EP) ..................................... 19169890

(51) Int. Cl.
C12Q 1/6806    (2018.01)
C12N 15/10    (2006.01)
C12Q 1/68    (2018.01)

(52) U.S. Cl.
CPC ....... C12N 15/1065 (2013.01); C12Q 1/6806 (2013.01)

(58) Field of Classification Search
None
See application file for complete search history.

(56) References Cited

U.S. PATENT DOCUMENTS 9,701,998 B2    7/2017  Hindson et al.
2011/0033854 A1    2/2011  Drmanac et al.
(Continued)

FOREIGN PATENT DOCUMENTS

EP    2376517 B1    1/2013
EP    3272879 B1    8/2019
(Continued)

OTHER PUBLICATIONS

Barabas et al., "Mechanism of IS200/IS605 Family DNA Transposases: Activation and Transposon-Directed Target Site Selection", Cell, published 2008) (Year: 2008).*
(Continued)

*Primary Examiner* — Heather Calamita
*Assistant Examiner* — Elizabeth Rose Lafave
(74) *Attorney, Agent, or Firm* — pH IP Law

(57) ABSTRACT

The present invention relates to methods for producing solid supports. The present invention further provides a mixture of said solid supports for tagmentation of target DNA for DNA sequencing approaches, a corresponding kit comprising the same and methods employing said mixture of solid supports and/or kit. Specifically, methods for producing sequencing libraries and corresponding DNA sequencing methods for
(Continued)

Figure 1:
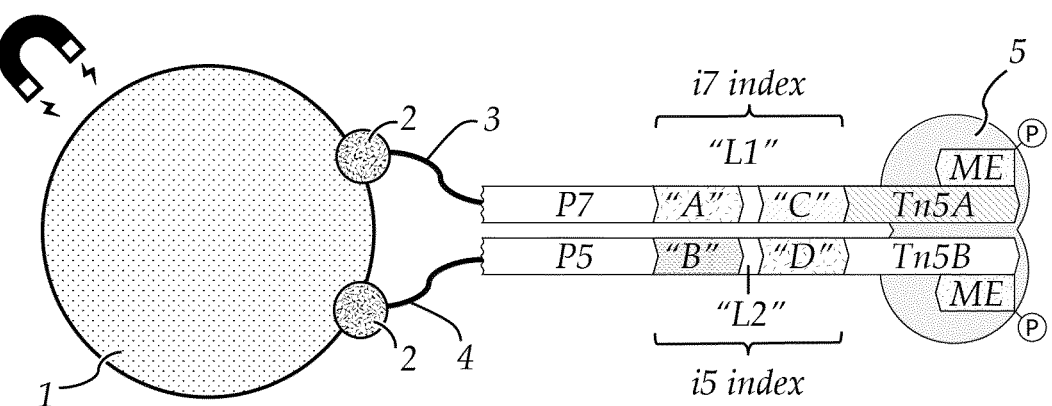

analyzing the generated sequencing libraries and tools used therein are provided. In particular, DNA sequencing approaches allowing preservation of contiguity information of long DNA fragments even when using short read sequencing approaches are disclosed. A key concept of the present invention is to employ segmented barcodes, with every barcode segmented allowing for barcode error detection and correction on a segment level. Preferred barcode sequences employed are characterized in that they comprise no linker sequences or only linker sequences of one or two nucleotides in length between the barcode segments.

17 Claims, 39 Drawing Sheets

Specification includes a Sequence Listing.

(56)                     References Cited

U.S. PATENT DOCUMENTS

| | | | |
|---|---|---|---|
| 2014/0323316 | A1 | 10/2014 | Drmanac et al. |
| 2015/0176071 | A1 | 6/2015 | Fisher et al. |
| 2018/0195112 | A1 | 7/2018 | Lebofsky et al. |
| 2018/0245069 | A1* | 8/2018 | DeSantis .............. C12Q 1/6869 |

FOREIGN PATENT DOCUMENTS

| | | | |
|---|---|---|---|
| WO | WO 2012/061832 | 5/2012 | |
| WO | WO 2014/093676 | 6/2014 | |
| WO | WO 2016/061517 | 4/2016 | |
| WO | WO-2016123692 A1 * | 8/2016 | ........ B01L 3/502761 |
| WO | WO 2016/168351 | 10/2016 | |

OTHER PUBLICATIONS

Curay et al., "T-Cell Immunotherapy: Looking Forward: T Cell Immunotherapy: Optimizing Trial Design" Bethesda, Maryland Sep. 10-11, 2013) (Year: 2013).*
Amini et al., "Haplotype-resolved whole genome sequencing by contiguity preserving transposition and combinatorial indexing," *Nature Genetics*, 46(12)1343-1349, 2014.
Extended European Search Report issued in European Application No. 19169890.1, mailed Jan. 27, 2020.
Lyons et al., "Large-scale DNA Barcode Library Generation for Biomolecule Identification in High-throughput Screens," *Scientific Reports*, 7(1):13899, 2017.
PCT International Preliminary Report on Patentability issued in International Application No. PCT/EP2020/053948, mailed Aug. 10, 2021.
PCT International Search Report and Written Opinion issued in International Application No. PCT/EP2020/053948, mailed Jun. 23, 2020.
Wang et al., "Efficient and unique cobarcoding of second-generation sequencing reads from long DNA molecules enabling cost-effective and accurate sequencing, haplotyping, and de novo assembly," *Genome Research*, 29(5):798-808, 2019.
Wang et al., "Efficient long single molecule sequencing for cost effective and accurate sequencing, haplotyping, and de novo assembly," *bioRxiv*, retrieved from https://biorxiv.org/content/10.1101/324392v3.full.pdf, version posted 2018.
Zhang et al., "Haplotype phasing of whole human genomes using bead-based barcode partitioning in a single tube," *Nature Biotechnology*, 35(9):852-857, 2017.
Buschmann & Bystrykh, "Levenshtein error-correcting barcodes for multiplexed DNA sequencing," *BMC Bioinformatics* 14:272, pp. 1-10, 2013.
Cheng et al., "A simple bead-based method for generating cost-effective co-barcoded sequence reads," *Protocol Exchange*, Oct. 22, 2018, doi:10.1038/protex.2018.116.
Green et al., "Insertion site preference of Mu, Tn5, and Tn7 transposons," *Mob DNA* 3(1):3, pp. 1-6, 2012.
Hawkins et al., "Indel-correcting DNA barcodes for high-throughput sequencing," *PNAS* 115:E6217-E6226, 2018.
Kuleshov et al., "Whole-genome haplotyping using long reads and statistical methods," *Nature Biotechnology* 32:261-266, 2014.
Lazzarano et al., "Genetic mapping of species differences via in vitro crosses in mouse embryonic stem cells," *PNAS* 115:3680-3685, 2018.
Naumann & Reznikoff, "Tn5 transposase active site mutants," *J Biol Chem* 277:17623-17629, 2002.
Picelli et al., "Tn5 transposase and tagmentation procedures for massively scaled sequencing projects," *Genome Res* 24:2033-2040, 2014.
Zheng et al., "Haplotyping germline and cancer genomes with high-throughput linked-read sequencing," *Nature Biotechnology* 34:303-311, 2016.

* cited by examiner

1. Tn5 transposition (pre-cleavage)

2. Tn5 transposition (post-cleavage)

5. Amplify library (annealing)

ul of 0.1uM
complet duplex:  2       4       6       8       2       4       6       8
     ul of Tn5:  0.125  0.125  0.125  0.125  0.375  0.375  0.375  0.375

Lane :     1     2     3     4     5     6     7     8     9

Figure 8

*2. Ligation of first "alpha" segment and stem removal with exonuclease*

*3. Ligation of second "beta" segment and stem removal with exonuclease*

*4. Ligation of third "gamma" segment and single-stranding with exonuclease*

*Final product with loaded Tn5 transposome*

2. Ligation of first "alpha" segment and stem removal with exonuclease

3. Ligation of second "beta" segment and stem removal with exonuclease

*4. Ligation of third "gamma" segment and single-stranding with exonuclease*

*Final product with loaded Tn5 transposase*

HAPLOTAGGING—HAPLOTYPE PHASING AND SINGLE-TUBE COMBINATORIAL BARCODING OF NUCLEIC ACID MOLECULES USING BEAD-IMMOBILIZED TN5 TRANSPOSASE

The present invention relates to methods for producing solid supports, a mixture of said solid supports for tagmentation of target DNA for DNA sequencing approaches, a corresponding kit comprising the same and methods employing said mixture of solid supports and/or kit. Specifically, methods for producing sequencing libraries and corresponding DNA sequencing methods for analyzing the generated sequencing libraries and tools such as computer program products used therein are provided. The DNA sequencing approaches of the invention allow preserving contiguity information of long target DNA fragments even when using short read sequencing approaches. Thus, the sequencing approaches are particularly suitable for determining haplotype information and/or for sequencing complex microbiological consortia.

The determination of nucleic acid sequences ("sequences") enables the unambiguous detection of genetic variants in the form of disease-causing genes, polygenic genetic factors, genetic variants conferring specific traits, rare cancer variants or microorganisms. DNA's structure as a flexible, replicable molecule of unlimited extensibility makes it the perfect molecule for storing and passing on genetic information.

Understanding and reading the DNA sequence has become a matter of not only scientific, but also of everyday economic, biomedical and social importance. Recent advances in DNA sequencing technologies have made the reading of DNA sequences and detection of variations and mutations among individuals and organisms (often single nucleotide polymorphisms, or SNPs) inexpensive and routine. Much of this advance depends on fluorescence-based massively parallel sequencing exemplified by those offered by SOLEXA®/ILLUMINA® Inc. In commercial sequencing, ILLUMINA®'s short-read sequencing technology sets the industrial standard in data throughput and accuracy and is the driving force behind the genomic revolution in biomedicine.

While the use of fluorescence conversion in ILLUMINA®'s sequencing technologies enables extremely high sequencing throughput, the read lengths that can be achieved with this technology are limited to approximately 150-250 base pairs (bp) from either end of a short DNA fragment due to rapidly declining sequencing quality. This fundamental trade-off between throughput and short-vs-long reads with ILLUMINA TRUSEQ® technology means that often it is not possible to fully reconstruct linked variation (SNPs, insertions and deletions, but especially structural variation) beyond several thousands of basepairs (kbp) no matter how densely a sample is sequenced. This is a major shortcoming, given that in humans and most diploid organisms DNA is inherited and thus organized into "haplotypes", i.e., physically linked variation, ranging from 100 kbp, to many megabases (Mbp; e.g., the shortest human chromosomes span 47 Mbp). Clearly, there is a fundamental disconnect between the short DNA fragments (<500 bp) and haplotype blocks that are often more than 1000-fold longer.

Similarly, the loss of contiguity information in short-read sequencing also plagues the microbial metagenomics community, in which genetic material from whole microbial communities become jumbled into an indecipherable mix during the process of sequencing library construction. This greatly complicates metagenomics analysis; and has led to proxies that leave out much of the useful information one should have been able to glean from metagenomics data, with the very likely result of delaying antibiotic and drug discovery.

Despite its shortcomings, short-read sequencing dominates the rapidly expanding biomedical, agricultural and ecological sequencing market thanks to its low cost and high accuracy. However, there is a high need to redress the shortcomings of short-read sequencing to find an efficient solution to preserve long-range haplotype information while retaining the advantages of ILLUMINA®'s sequencing platform.

Current technologies to preserve long-range haplotype information fall broadly into two classes: 1) alternative long-read sequencing technology and 2) molecular phasing.

Long-reads techniques typically rely on the direct readout of sequence information as fluorescent or electrochemical signals from single-molecules, exemplified by the single-molecule real-time (SMRT) sequencing technology from PACIFIC BIOSCIENCES® and the nanopore sequencing technology from OXFORD NANOPORE®. While per-base sequencing costs vary (extremely high for PACIFIC BIOSCIENCES® and relatively low for OXFORD NANOPORE®), both platforms and similar single-molecule technologies suffer from an extremely high sequencing error rate (as many as 1 error in 5 bp, compared to 1 in 100 to less than 1 in 1000 for typical short-read benchmarks). In part, this comes down to fundamental physical principles of molecular noise in single-molecule sequencing, which may impose an upper limit on the accuracy of long-read sequencing results. In addition, since the relative advantage of long-read platforms lies in the extremely long DNA molecules, laboratory preparation for long-read sequencing often requires extremely delicate handling and dedicated instruments, staff, or both. In sum, the presently available long-read sequencing platforms currently do not offer a practical and reliable alternative to the broader problem of genotyping and haplotyping at scale (hundreds to many thousands of samples).

Unlike long-read sequencing, molecular phasing typically employs less error prone short-read sequencing and relies on retaining specific features of the original template DNA molecule to retain long-range information. Various forms of molecular phasing have played a pivotal role since the beginning of sequencing technology. The assembly of whole genomes, whether through the classical step-wise approach of assembling the human genome through constructing "tiles" of about 200 kilobasepairs (kbp) in size (e.g., bacterial artificial chromosomes or a "BAC"), or as a one-step "shotgun" approach as undertaken by Venter at Celera Corp, rely heavily on the use of packaged DNA molecules with various adapters, vector backbones and sequencing primers. The general principle being that only the actual sequence at both ends of the inserted DNA molecule is being sequenced (paired-end or BAC-end sequences), with the size of the insert DNA providing an additional piece of "scaffolding" or "linking" information. Similar concepts of "molecular phasing" have been developed to work with Illumina®'s sequencing technology, e.g., paired-end, mate-pair sequencing, fosmid ends, etc. However, these techniques are limited in that only a small fraction of the overall inserted DNA sequence is determined, regardless of the insert size. Since phasing depends on grouping linked DNA variants into clustered blocks, classical molecular phasing becomes increasingly inefficient as the insert size increases. This is because the diminishing correlation and thus utility of such linkage in the absence of intervening sequence decreases in a population of individuals as the distance between the sequenced ends increases. Together with the far greater effort and costs in generating large-insert libraries, mate-pair and similar molecular phasing techniques remain a niche application in the broader sequencing field.

A novel class of molecular phasing techniques variously known as synthetic long reads (Kuleshov et al., Nat Biotech 32, 261-266 (2014); doi: 10.1038/nbt.2833), contiguity preserving transposition ("CPTseq", described in Amini et al., Nat Genet. 2014 46 (12): 1343-9; WO 2016/061517A2; and Zhang et al., Nat. Biotech. 35, 852-857 (2017)), "linked-read" sequencing (Zheng et al., Nat. Biotech. 34, 303-311 (2016), or single tube long fragment read (stLFR, described in Wang et al., 2018 bioRxiv, doi: 10.1101/324392, Wang et al., 2019 Genome Res., doi: 10.1101/gr.245126.118, and Cheng et al., 2018, Protocol Exchange, doi: 10.1038/protex.2018.116) has emerged to address the above shortcomings. Their common principle relies on isolating individual DNA molecules ("compartmentalization"), labeling individual molecules with DNA-based barcodes specific to each compartment and pooling the subsequent mix of DNA templates ("sequencing libraries") into a single short-read sequencing run. After sequencing, the original molecules can be computationally reconstructed by regrouping the short reads that share the same barcode. Such sequencing approaches, which are referred to as linked-read technologies or linked-read sequencing herein below, benefit from an increased number of sequencing reads per original DNA molecule, and thus their utility in recovery of linked haplotypes increases, rather than decreases, as a function of their length. They also compare favorably with long-read sequencing in retaining high throughput, low per-base sequencing costs and high accuracy. While these linked-read technologies, which are discussed in more detail below, represent a promising approach towards the broad adoption of haplotype-aware sequencing, the currently available technologies still suffer from a number of disadvantages.

At present, linked-read sequencing technologies are still not generally adopted for most sequencing purposes, because both of the two leading options, ILLUMINA's CPTV2-SEQ® (Zhang et al., 2017) and 10× Genomics' Chromium technology (Zheng et al., 2016) require inconvenient instrumentation and/or customization, the latter typically preventing multiplexing with sequencing libraries generated for the same sequencing platform but with different library preparation methods. As a result, both their one-time costs and library preparation costs are still too high (>200€ per sample) to adopt beyond a small number of samples.

The above mentioned linked read sequencing method described by Zheng (loc. cit.) and commercialized by 10× Genomics uses a microfluidics-based droplet compartmentalization of the target DNA molecules to molecularly attach barcodes to DNA molecules that allow linking of short reads ("linked reads") in a way that corresponds to the original long DNA molecule (Zheng et al., 2016; loc. cit.). The technology relies on pairing barcodes and DNA molecules in each microdroplet. This approach requires highly complex and proprietary instrumentation and suffers from low throughput due to labor-intensive microfluidics processing that is also prone to errors causing barcode collision, e.g. by having two target DNA molecules in the same microdroplet. Further the technique also requires customization of the sequencing, (e.g., using custom sequencing primers) as such so that running DNA libraries generated with different approaches side-by-side in the same flow cell is infeasible. It is of note that this system uses barcodes that are positioned "in line" with the target DNA fragments, i.e. are sequenced in the same read as the target DNA. This configuration reduces the read length within the target DNA fragment and, thus reduces sequencing coverage.

Related linked read sequencing approaches using numerous different partitions for pairing target DNA molecules with barcodes are disclosed in WO 2014/093676 A1 and U.S. Pat. No. 9,701,998 B2. These approaches suffer from similar disadvantages and use adapter ligation to add a barcode sequence to the target DNA fragments which is error-prone and bears the risk of a significant loss of target DNA molecules by inefficient adapter ligation.

US2011/0033854 A1 describes also a method for linked read sequencing. However, again the method requires dividing the target DNA into a plurality of different aliquots in microdroplets. Such method requires special instrumentations.

US 2018/0195112 A1 describes a further linked-read method that requires distribution of target DNA molecules in partitions. The method requires further an extra PCR amplification step for adding barcodes in each of the partitions.

WO 2016/168351 A1 describes a method for generating a high diversity of segmental, combinatorial barcodes for the purpose of biomolecular quantification. However, the disclosed method does not consider some constraints in barcode length, primer annealing sites during index sequencing relevant for practical use.

Further options for linked read sequencing are the so-called "contiguity-preserving transposition" sequencing (CPT-seq; see Amini et al., 2014, loc. cit. and WO 2016/061517 A2; as well as a subsequent variant thereof referred to as CPTv2-seq in Zhang et al., 2017, loc. cit.). These methods use Tn5 transposase tagmentation ("tagging" and "fragmentation"; see, e.g., WO2016/061517 A2) for the molecular barcoding step. The use of Tn5 tagmentation to generate a sequencing library is known from the Illumina's Nextera® sequencing technology and has been widely used for generating sequencing libraries (see, e.g., WO 2012/061832. Specifically, Zhang et al. (loc. cit.) described that tagmentation can be performed as a single tube reaction if transposomes are immobilized on beads (CPTv2-seq, a process called "virtual compartmentalization").

While CPT-seq and its subsequent elaborations have laid out the concept of clonal indexing, i.e. adding the same barcode to the short library DNA fragments derived from the same target DNA molecule, major limitations remain in place to prevent it from being broadly adopted.

The CPT-seq method, as disclosed by Amini (loc. cit.) and WO 2016/061517 A2 involves two or more separate steps. The first step of CPT-seq introduces a first set of barcodes through Tn5 transposition, followed by splitting of the bulk samples into separate pools for subsequent amplification or ligation of a second set of barcodes. Having these two steps is cumbersome and the required additional handling involving PCR amplification increases the chance of introducing undesired nucleic acid exchanges that can decrease sequencing accuracy. Most crucially, the method does not lend itself to high-throughput, highly multiplexed applications, which would be necessary if CPT-seq were to be performed on a large number of samples simultaneously. Another method for generating barcoded sequencing libraries involving transposon-based fragmentation and subsequent barcode attachment involving PCR amplification with barcoded primers is described in US 2014/03233.16 A1.

CPTv2-seq as described by Zhang et al. (loc. cit.) uses a slightly different strategy involving tagmentation on beads involving tagmenting target DNA with pre-assembled transposome complexes and hybridization thereof to beads comprising bead-specific oligonucleotides comprising two barcode sequences separated by a splint 1 and splint 2 sequence. While the method avoids an amplification step the hybridization of the beads and the transposome complexes adds additional complexity to the protocol that may introduce errors and may strongly depend on the specific hybridization conditions used. The barcode and oligonucleotide synthesis setup further requires complex and cost-intensive customized synthesis and instrumentation.

Another major limitation of CPTv2-seq of Zhang et al. is that this method only employs 147,456 different barcode combinations. As described in more detail below, a set of only 147,456 unique barcodes falls far short of the number required to avoid barcode re-use (a form of "barcode collisions") due to the high number of DNA molecules present in a typical reaction volume.

Lastly, CPTv2-seq has the disadvantage of producing sequencing libraries that are not compatible with standard ILLUMINA NEXTERA® sequencing reagents and thus require customized sequencing primers and run protocols for both sequencing the barcodes and the target sequence. As it is presently configured, it precludes the ability to run samples generated through CPTv2-seq together with NEXTERA® or TRUSEQ® protocols in the same ILLUMINA® flow cell. This is a major drawback that greatly limits the reach of CPTv2-seq, because the vast majority of academic and commercial sequencing facilities operate under the so-called "multiplexed" mode, in which individual sample libraries occupy only individual lanes-if not a small fraction of a lane-in a typical ILLUMINA® sequencing flow-cell. Due to the design of the beads used in CPTv2-seq, it is highly inconvenient, if not impossible, to operate the libraries generated with this method on an Illumina HiSeq® or NovaSeq® sequencing instrument with standard sequencing primers and settings, which is however required for multiplexing. Instead, whole sequencing runs featuring exclusively CPTv2-seq libraries may have to be scheduled to enable access to the CPTv2-seq technology. This significantly reduces the multiplexing capability and leads to additional costs and unnecessary delays.

Methods involving on bead tagmentation have also been described in US 2015/0176071 A1 and US 2018/0245069 A1. Besides having similar disadvantages than the other presently known linked read sequencing approaches, these methods are severely hampered by the low barcode diversity provided. In particular, these documents fail to provide methods for providing the barcode diversity required for recovering DNA contiguity efficiently.

Barcode diversity is a key component in uniquely marking individual DNA molecules which is of particular importance when it comes to de novo assembly and haplotype identification of DNA sequences using linked read strategies. The minimal practical threshold for barcode diversity should be set by the probability of having two overlapping but non-contiguous target DNA molecule nonetheless sharing the same barcode and thus create a false link, a scenario known as "barcode collision". 10× Genomics' Chromium platform features quite long 16 nt barcode sequences with 737,280 validated barcodes (out of 4,792,320 total), which is a high number but still insufficient, in particular in the context of higher target DNA concentrations. Further the structural configuration of the barcodes as a continuous barcode sequence with a length of 16 nucleotides makes error correction and detection in the barcode sequences more computationally intensive than necessary. Due to the tendency of the microfluidic device to co-package multiple target DNA molecules into the same micro-droplet the actual barcode collision rate is further increased to about 2%. CPTv2-seq as described by Zhang et al. (loc. cit.) compares poorly, as it only features 147,456 (384×384) distinct barcodes, which is far too low for most setups to avoid barcode collision in most practical usage scenarios.

Another option for linked read sequencing recently described by Wang et al. and Cheng at al. (loc. cit.), referred to as "stLFR", uses 3.6 billion unique barcode sequences in a tagmentation based strategy employing beads with uniquely barcoded oligonucleotides for capturing in solution tagmentation products of target DNA. However, despite the high barcode diversity, this approach suffers from a number of disadvantages. For instance, the method uses in solution transposition and only subsequent binding to the beads, which requires the additional step of hybridizing the transposome complexes to the beads after tagmentation and subsequent ligation of the bead bound oligonucleotides. These additional hybridization and ligation steps add complexity and are additional sources for errors and losing coverage. Moreover, the barcode diversity is only achieved by employing three barcodes that are separated by linker sequences of 6 nucleotides, which results in a lengthy total barcode sequence/region. The linkers are introduced by the ligation strategy used for the split-and-pool ligation assembly of the bead bound oligonucleotides. The individual barcodes used have a length of ten nucleotides each. The overall configuration of the barcode region used by Wang et al. (loc. cit.) in order to achieve the high barcode diversity comprises 42 nucleotides which increases complexity of computational demultiplexing. This set up is also not optimally configured to be sequenced by the commercially most common ILLUMINA® platform. Should this be adopted to be run not using the custom BGI sequencer, but the ILLU-MINA HISEQ® or NOVASEQ® sequencers, dedicating so many index sequencing cycles to the barcode sequence would take away cycles otherwise dedicated to the target DNA. In addition, it also necessitates custom sequencing primers. Lastly, despite having barcode complexity, Wang et al. does not fully address the issue of barcode loss caused by sequencing errors and/or errors introduced in the barcodes during production (e.g., due to undesired mutations in the oligonucleotides employed in a split-and-pool assembly of the barcoded oligonucleotides on the beads). Such errors in sequencing and barcode synthesis occur more frequently with increasing barcode region length. Thus, the higher barcode diversity provided by Wang et al. (loc cit.) comes with an increased risk of barcode and, thus sequence information loss by barcode sequencing and/or synthesis errors.

Accordingly, there is still a high need to improve the currently available linked-read sequencing technologies in respect of barcode collision and barcode loss. Moreover, there is a particular need to provide high barcode diversity with a minimal risk for barcode collision and/or loss for linked-read sequencing technologies using on bead tagmentation strategies, preferably without seriously affecting the capacity of multiplexing with differently generated sequencing libraries.

Moreover, there exists a high need for a low-cost and efficient method to obtain haplotype information directly from individual samples. Current state-of-the-art approaches are not adequate to the task due to high entry or operating costs (proprietary instruments or cumbersome techniques) or incompatibility with prevalent sequencing protocols. As configured for example in US 2018/0195112 A1 or WO 2016/168351 A1, there is no practical way of generating an sequencing library such as an ILLUMINA® library without extensive modification to the sequencing procedure, use custom primers, or both. Moreover, the technical aspects of existing technology face limits in scalability that may make solving the haplotyping problem challenging, if not impossible.

Thus, the problem underlying the present invention is to provide new means and methods for sequencing library generation addressing one or more of the above-mentioned disadvantages, thereby allowing easy and accurate linked read library generation and sequencing. In particular the present invention aims at providing means and methods for easier and/or improved clonal barcoding strategies using solid support based tagmentation. Another critical problem to overcome is the provision of a barcoding strategy and means therefore that allow fast and reliable bioinformatic analysis and determination of contiguous sequence information. This can further facilitate the use of short read based sequencing technologies in gaining contiguous sequence information, e.g. for haplotyping. A further problem to be solved is the provision of methods for producing solid-supports for solid support based tagmentation having high barcode diversity while keeping barcode length moderate and keeping downstream demultiplexing of barcodes easy.

The present invention solves these technical hurdles by providing a novel and inventive mixture of solid supports for on bead-tagmentation with an exceptionally clever solid support-specific barcode tag design, novel and inventive methods for producing such mixture of solid supports and methods and uses thereof in generating sequencing libraries preserving contiguity information of target DNA. Further, easy to use and highly accurate sequencing methods using the sequencing libraries generated with the means and methods of the present invention involving a demultiplexing strategy making use of the novel and inventive barcode tag design are provided. The sequencing methods of the invention also involve novel and inventive computer program products that, when executed by a computer, conduct the advantageous barcode demultiplexing of sequencing results generated from the sequencing libraries generated with the methods of the present invention.

The present invention provides a method to produce linker-free segmented barcodes. Accordingly, the present invention relates to a method for producing solid supports with attached solid support specific segmented DNA barcode sequences, wherein the barcode segments of the barcode sequences are directly linked to each other, said method comprising:

a) providing solid supports in a plurality of reaction compartments, wherein each solid support has multiple identical copies of a single stranded DNA oligonucleotide selected from a predefined set of single stranded DNA oligonucleotides A attached thereto, wherein the oligonucleotides are attached to a solid support via the one end, the end being the 5' or the 3' end for all oligonucleotides, and wherein the oligonucleotides have a free second end that is formed by a barcode segment A;

b) ligating in each of the reaction compartments a polynucleotide selected from a predefined set of polynucleotides B to the free end of the solid support-attached single-stranded oligonucleotides, wherein each of the polynucleotides of the set B comprises a double stranded section and a single stranded section, wherein the single stranded section is reverse complementary to the free end of the solid support-attached single-stranded oligonucleotides of set A and comprises universal nucleotides at the positions being reverse complementary to the barcode segment A, wherein the single stranded section comprises at least 6, at least 8, at least 10 or at least 12 (reverse complementary) nucleotides other than the universal nucleotides (preferably at most 10, at most 12, at most 14, at most 16 or at most 18 (reverse complementary) nucleotides other than the universal nucleotides), wherein the double stranded section comprises a barcode segment B positioned directly at the end facing the single stranded section, wherein the polynucleotides of the set B differ in the sequence of the barcode segment B, preferably by at least two base pairs; and c) removing the strands originating from the single stranded section from the solid supports by exonuclease digestion so as to generate on the solid supports single stranded oligonucleotides comprising a barcode segment A and a barcode segment B directly linked to each other.

The inventive method, including the herein disclosed embodiments, may alternatively also be referred to as a "method for generating barcoded solid supports" comprising these steps.

Figure 22:
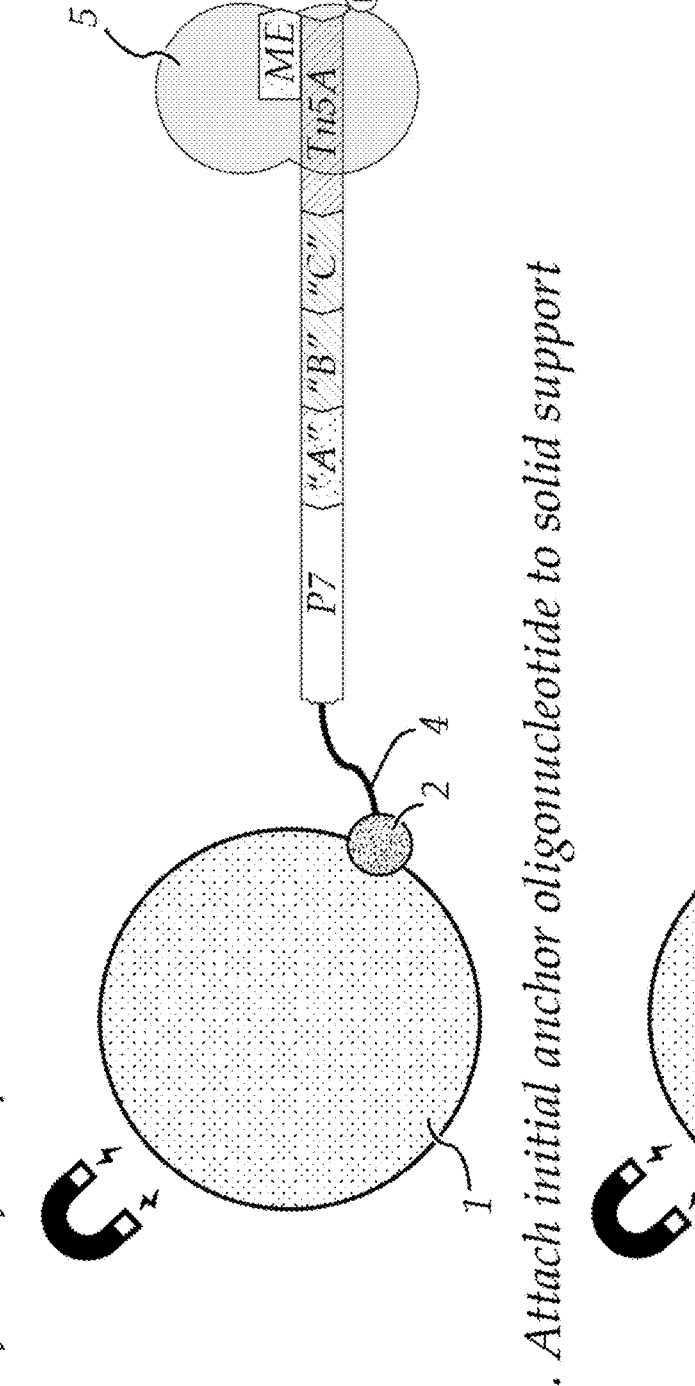
Figure 22:
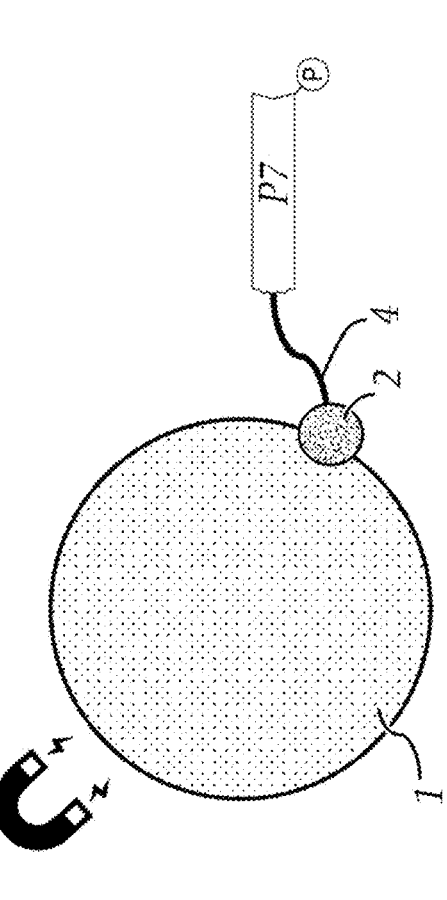
Figure 22:
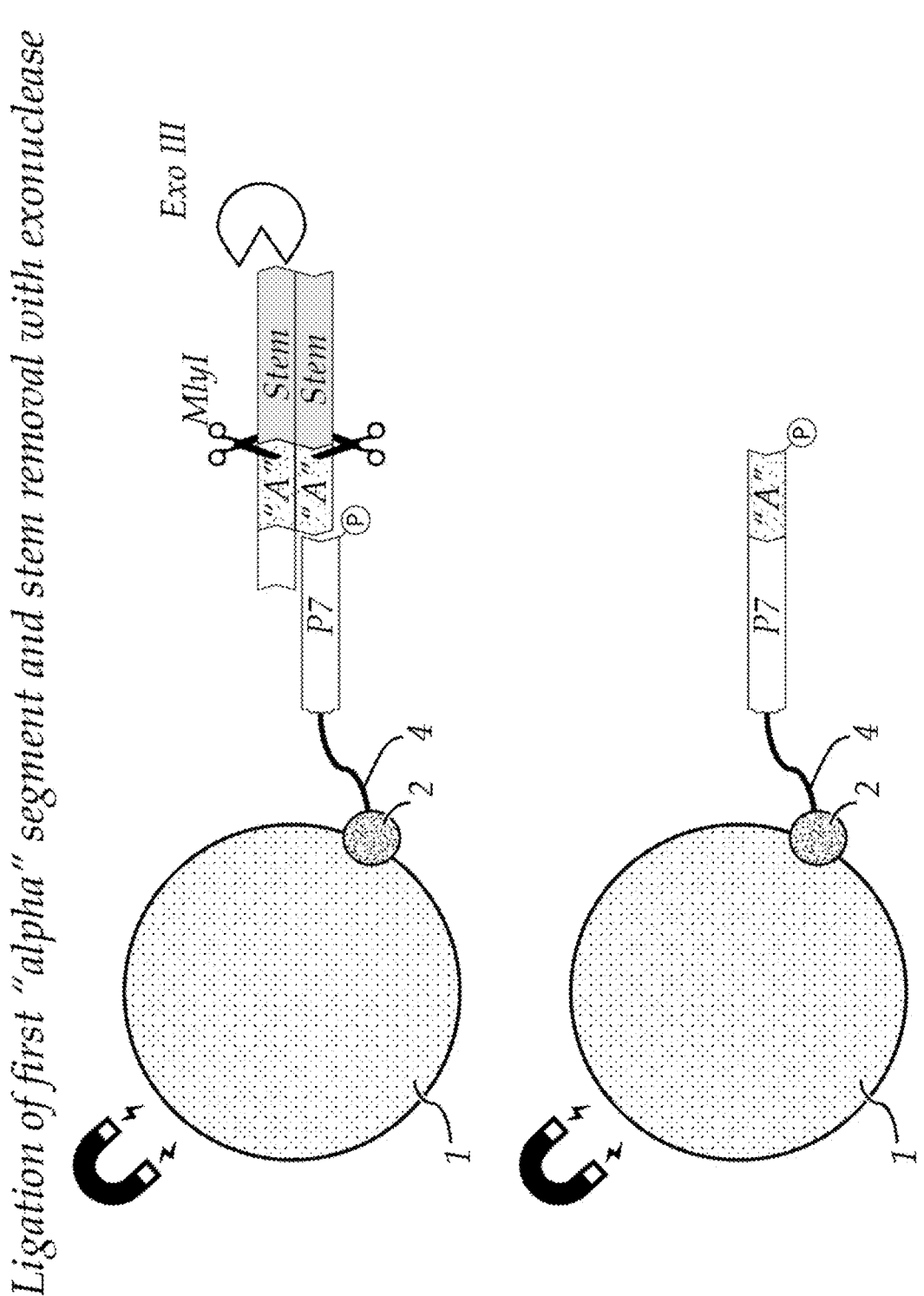
Figure 22:
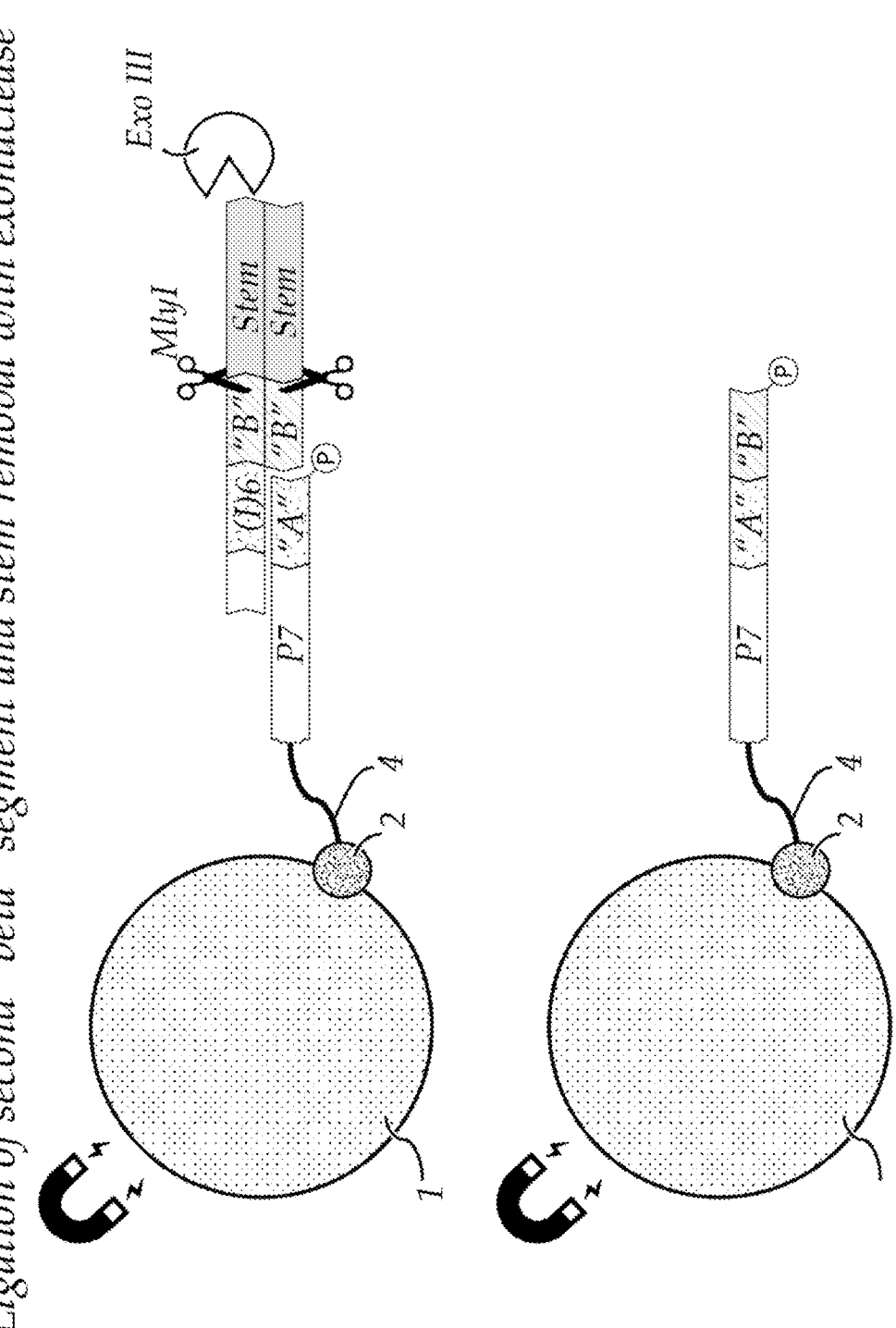
Figure 22:
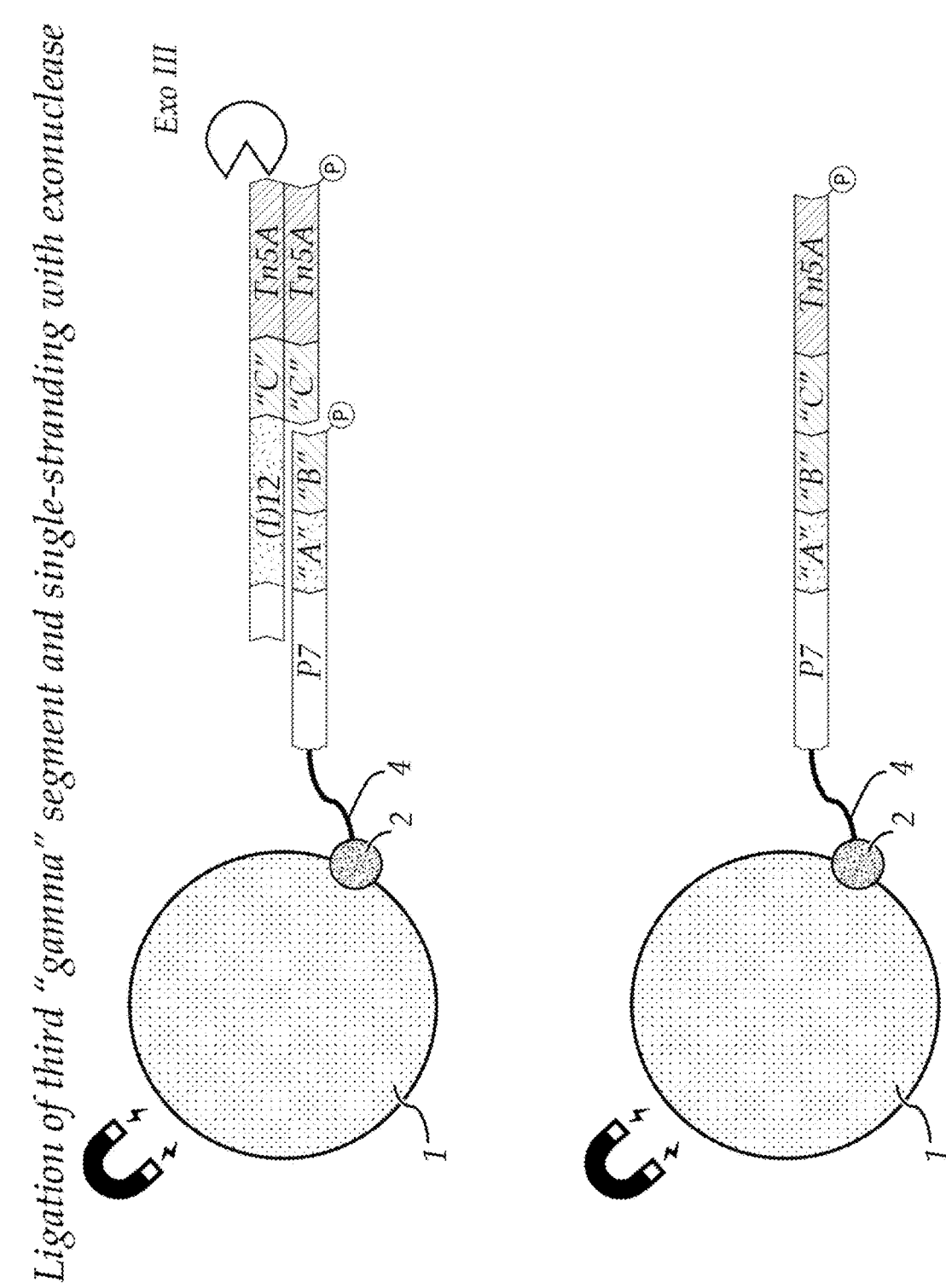
Figure 22:
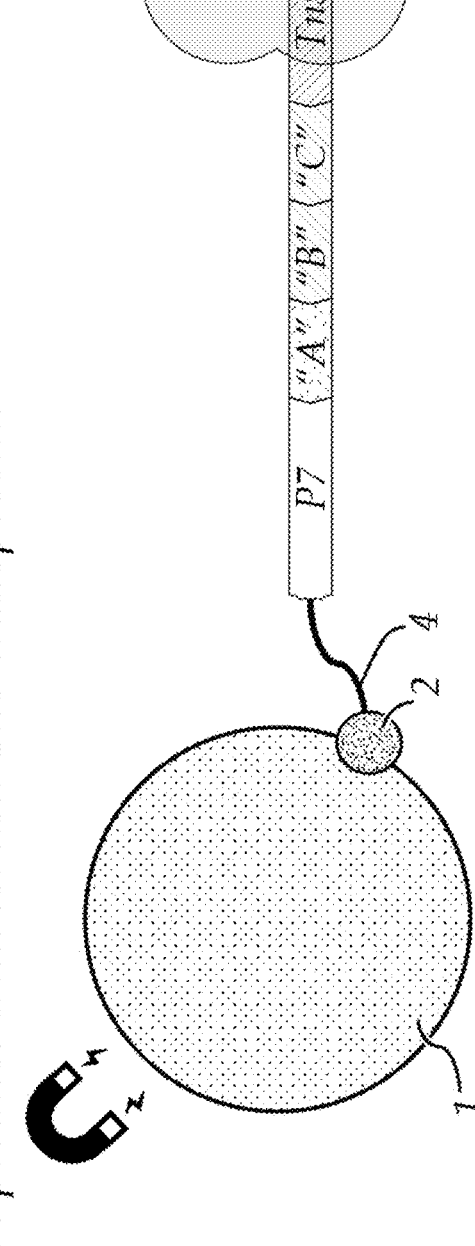
Figure 23:
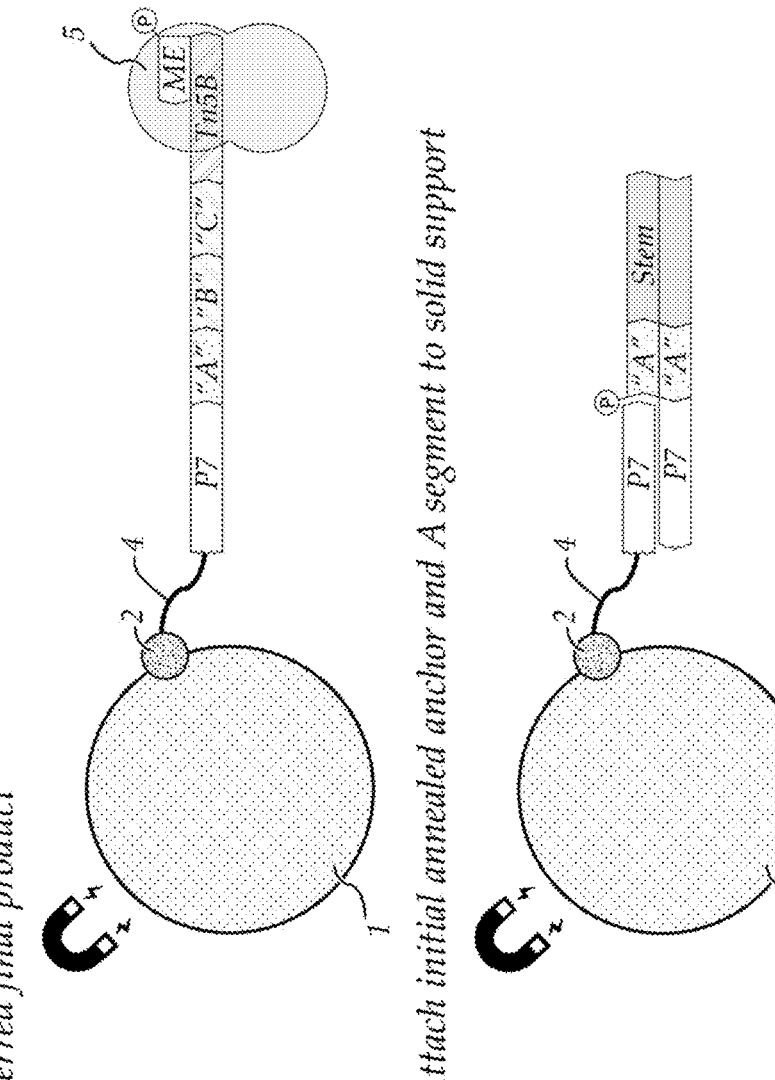
Figure 23:
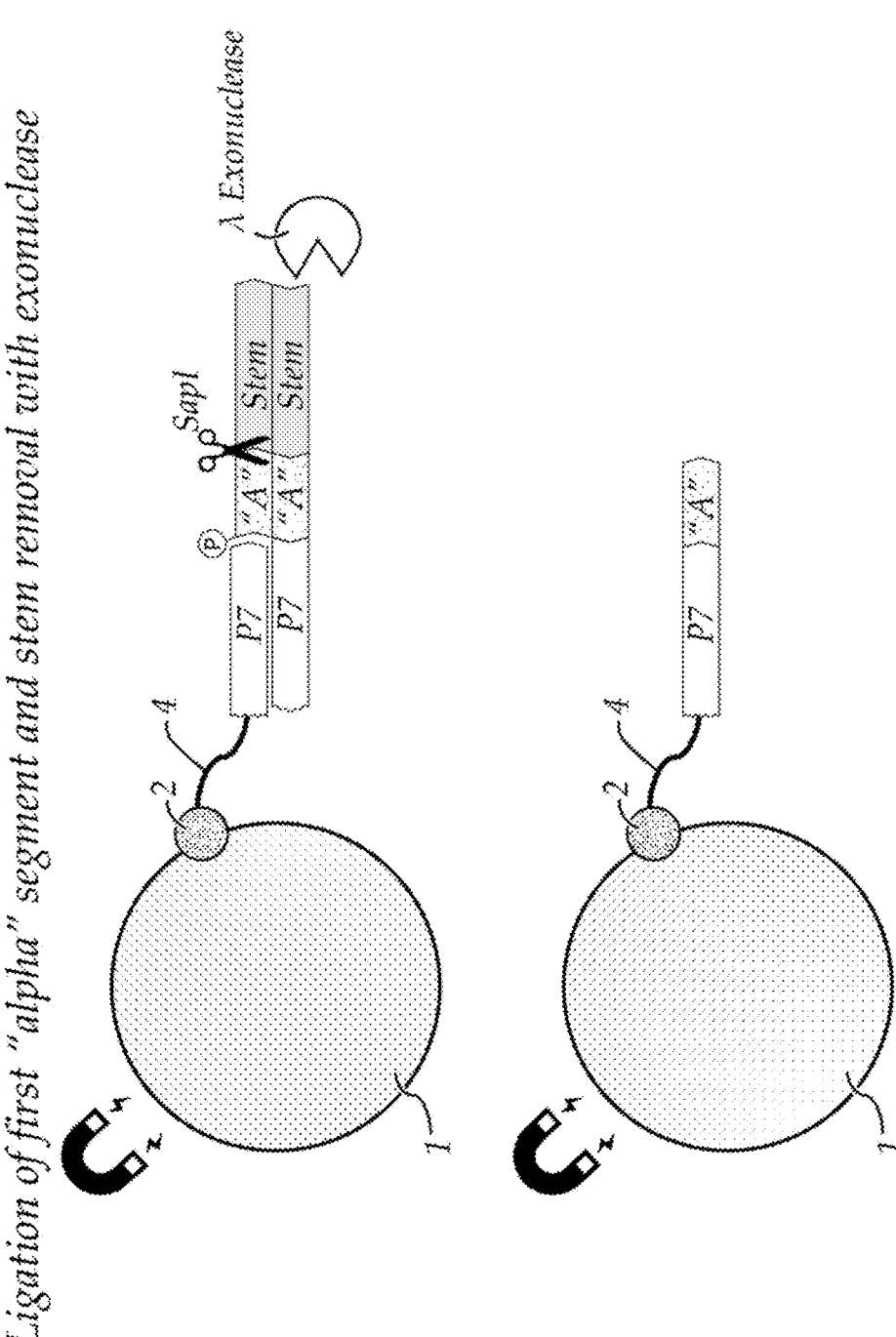
Figure 23:
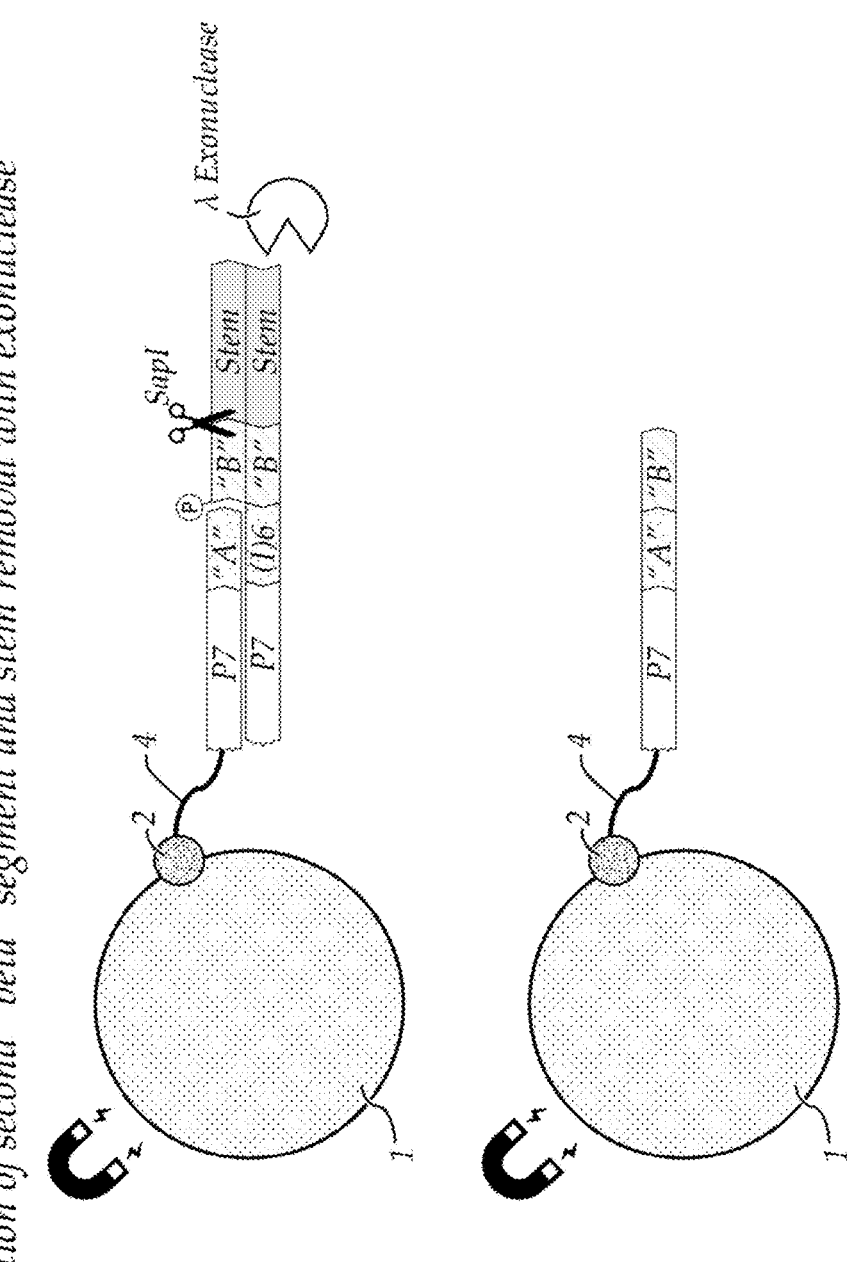
Figure 23:
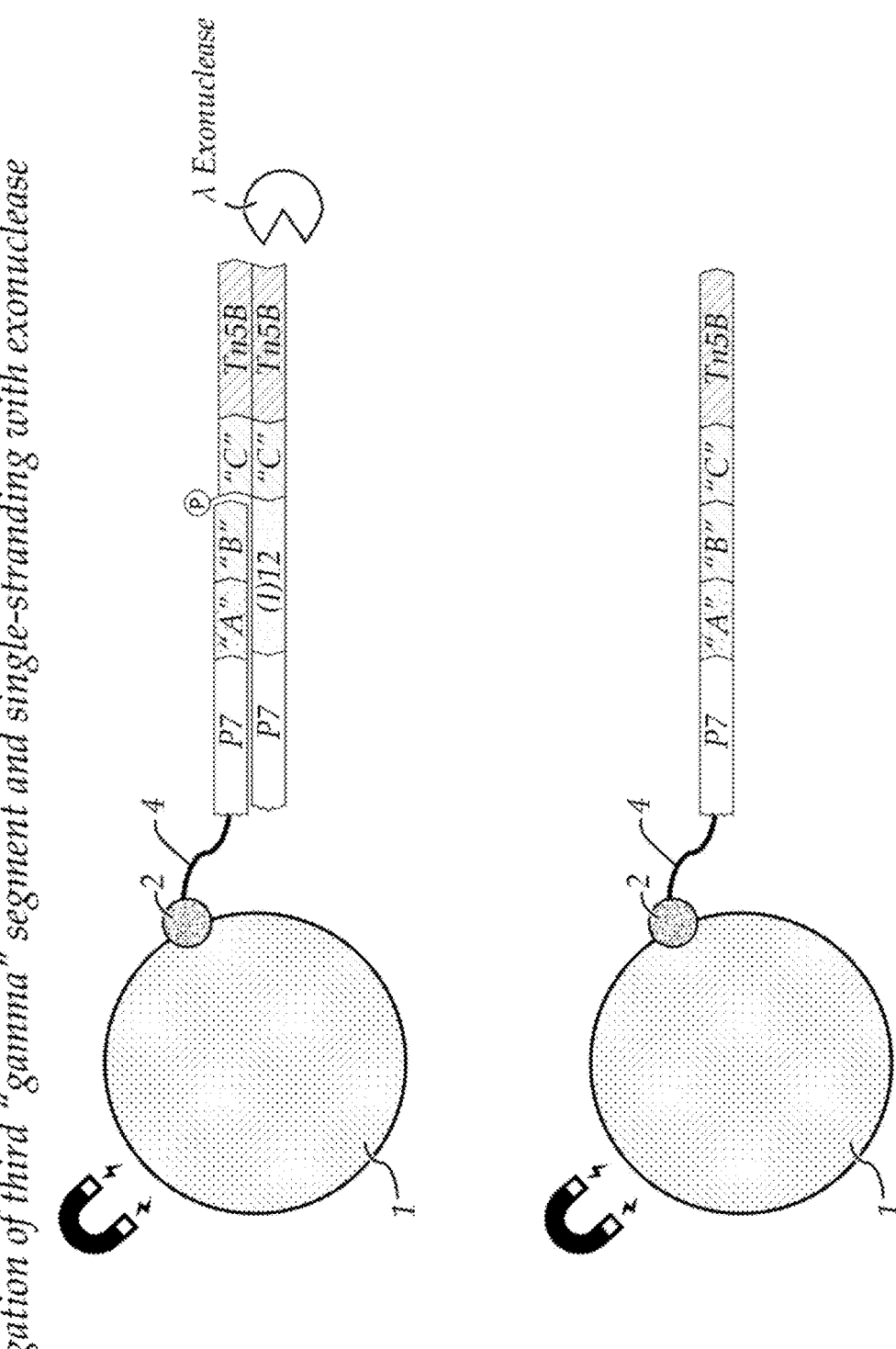
Figure 23:
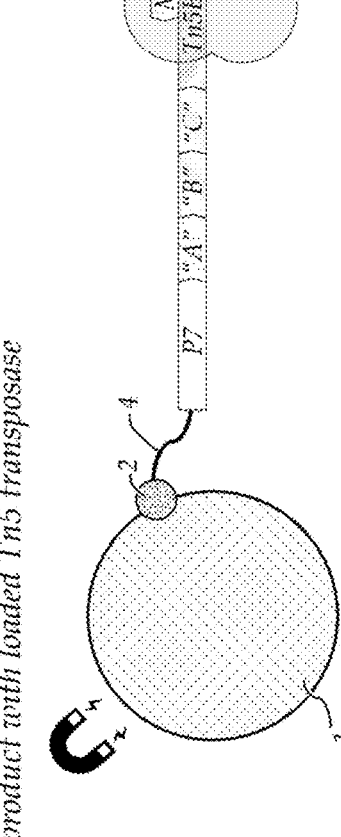

The method according to this aspect is essentially based on the steps 1 to the upper part of step 3 illustrated in FIGS. 22 and 23 enclosed herein. Exemplary but non-limiting embodiments are explained in Examples 13 and 15. The method allows for linker-free ligation of barcode segments to obtain a segmented barcode sequence. The linker-free assembly keeps barcode sequence length short. This in turn allows, e.g., using the limited sequence length in indexing positions most efficiently. Thus, using these methods is also advantageous in the context of producing a mixture of solid supports according to the present invention.

In particular, and as described below in more detail, the present disclosure provides a combined solution for achieving extremely high barcode diversity with a minimal barcode length and allowing for highly efficient demultiplexing and error detection and correction. In accordance with this invention, a simple and reliable synthesis procedure is provided, wherein segments according to the disclosed barcode design are preferably linker-less combined. This provides for a highly effective, easy to use and accurate sequencing, applying short read sequencing technologies. However, as also disclosed herein and in alternative embodiments of the present invention, the segments may also be combined using short linker sequences, preferably using linkers of one or two nucleotides in length each.

As used herein "segmented" or "segmental" in context with barcodes, barcode sequences or barcode structure means that a barcode comprises at least two sequence sections, i.e. barcode segments. The barcode segments are preferably predefined in length. The sequence of each barcode segment is preferably selected from a predefined set of error-correcting barcodes in the context of the invention. The barcode segments may be directly adjacent or separated by a linker sequence.

In step a) it is preferred that a mixture of solid supports is provided in each of the reaction compartments, wherein each solid support within the mixture has multiple identical copies of a single stranded DNA oligonucleotide selected from a predefined set of single stranded DNA oligonucleotides A attached thereto. The mixture in each reaction compartment may be identical or different. Such mixture of solid supports may be generated before being placed in the reaction compartments of step a) as follows. Each of the oligonucleotides of the set A may be provided in a separate reaction compartment and may be attached to solid supports in said separate reaction compartments so that in each reaction compartment solid supports with multiple copies of the respective oligonucleotide of set A are produced. Next, the solid supports may be pooled and/or mixed. This mixture or pool may then be distributed to the reaction compartments for step a).

In the context of the present invention, "solid support(s)" refers to "microsphere(s)", "bead(s)" (e.g. microbeads) or "particle(s)" with a (maximum) diameter in a μm to nm range. Most preferably beads (e.g. microbeads) are employed as solid support. The solid supports of the invention may have various shapes and sizes. The solid supports in the mixture may be substantially similar (or identical) in size and shape or may have different sizes and shapes. The solid supports may be magnetic or non-magnetic, with magnetic being preferred due to the easier handling. Preferred solid supports are beads such as microbeads (e.g. magnetic microbeads, such as Dynabeads). Different types of beads for use with biological samples are known in the art (Ruffert 2016, Micromachines 7 (2016), 2:21; found on the world wide web at assets.thermofisher.com/TFS-Assets/ CDD/Catalogs/CAT-10021654-PT-TECH-GUIDE-EN.pdf). In particular also materials from which beads can be made from and coatings for generating hydrophobic or hydrophilic surfaces of the beads are known in the art (found on the world wide web at helix.mcmaster.ca/Surface_Activated-_Dynabeads.pdf). While in principle any beads that allow for transposase activity may be employed in the context of the present invention, it is preferred to use magnetic Dynabeads, preferably M-280 beads. Suitable bead compositions also include, but are not limited to, plastics, ceramics, glass, polystyrene, methylstyrene, acrylic polymers, paramagnetic materials, thoria sol, carbon graphite, titanium dioxide, latex or cross-linked dextrans such as Sepharose, cellulose, nylon, cross-linked micelles and Teflon. Whereas the solid supports (e.g., beads) are preferably spherical, they do not need to be spherical; irregular particles may also be used. Alternatively, or additionally, the solid supports (e.g. beads) may be porous.

The solid supports have preferably a (maximum) diameter in the μm or nm range. The diameter of each of the solid supports may be in the range of about 1 μm to about 100 μm, preferably in the range of about 1 μm to about 5 μm. A particularly preferred diameter is about 2.8 μm. As mentioned above, the solid supports are preferably beads (e.g. microbeads). Accordingly, the solid supports may be beads having a diameter of about 1 μm to about 100 μm, preferably of about 1 μm to about 5 μm and most preferably about 2.8 μm. The sizes of the solid supports (e.g. beads) may range from nanometers, i.e. about 10 nm, to μm, e.g. 0.5 μm in diameter. For instance, solid supports (e.g., beads) may be used. In some embodiments, solid supports such as beads can be about 0.1, 0.2, 0.3, 0.4, 0.5, 0.6, 0.7, 0.8, 0.9, 1, 1.5, 2, 2.5, 2.8, 3, 3.5, 4, 4.5, 5, 5.5, 6, 6.5, 7, 7.5, 8, 8.5, 9, 9.5, 10, 10.5, 15, 20, 25, 30, 35, 40, 45, 50, 55, 60, 65, 70, 75, 80, 85, 90, 95, 100, 150, or 200 μm in diameter. Particularly preferred diameters are indicated above. The diameter may be selected according to the length of target DNA molecules in the samples to be tagmented. Longer molecules may require solid supports with a larger diameter in order to ensure that the molecule is tagmented on one bead only. The maximum diameter may be accordingly, e.g., about 0.1, 0.2, 0.3, 0.4, 0.5, 0.6, 0.7, 0.8, 0.9, 1, 1.5, 2, 2.5, 2.8, 3, 3.5, 4, 4.5, 5, 5.5, 6, 6.5, 7, 7.5, 8, 8.5, 9, 9.5, 10, 10.5, 15, 20, 25, 30, 35, 40, 45, 50, 55, 60, 65, 70, 75, 80, 85, 90, 95, 100, 150, or 200 μm, preferably in the range of about 1 μm to about 100 μm, more preferably in the range of about 1 μm to about 5 μm, most preferably about 2.8 μm.

The "target DNA" or "target DNA sample(s)" as employed in the context of the present invention can in principle be any double-stranded or at least partially double stranded DNA sample. The target DNA may be a single DNA molecule or a mixture of multiple copies of the same DNA molecule. Preferably, the target DNA is a mixture of different DNA molecules. The target DNA may be genomic DNA, cDNA (e.g. generated by reverse transcription of RNA, such as mRNA) or DNA from an organelle (such as mitochondria or chloroplasts). Particularly preferred is the employment of genomic DNA. The target DNA may be DNA derived from a single cell, fractions thereof or organelles. The target DNA may be DNA resulting from amplification of a DNA sample by PCR. The target DNA may be a mixture of genomic DNAs (or portions thereof) of different organisms. The target DNA may also be a mixture of genomic DNAs from microbiological consortia. The target DNA (or the RNA from which the DNA is produced by reverse transcription) may be obtained from a biological sample or a patient sample. The term "biological sample" or "patient sample" as used herein includes samples such as tissues and bodily fluids. "Bodily fluids" may include, but are not limited to blood, serum, plasma, saliva, cerebral spinal fluid, pleural fluid, tears, lacteal duct fluid, lymph, sputum, urine, amniotic fluid, and semen. A sample may include a bodily fluid that is "acellular." The target DNA may be purified or may contain further components. Preferably, the target DNA is purified and free of nucleases. Target DNA may also be a portion of DNA that is enriched from a mixture of DNA. Corresponding methods for enriching certain target DNA, e.g. via certain predefined sequence features are known in the art and described (Mamanova et al., *Nat Methods.* 2010, 7:111-118). The DNA sequencing method of the invention may accordingly comprise corresponding method steps for enriching subsets of target DNA molecules (e.g. based on a keratin sequence or DNA modification) Similarly, the target DNA may be enriched for a certain sequence or DNA modification. The target DNA as employed in the context of the invention may be purified and/or length selected, e.g. by using Agarose gel electrophoresis.

As used herein "DNA" may also include other nucleotides than A, T, G and C, in particular also including modified nucleotides/nucleobases, as long as the DNA can still be transposed by a transposase. In particular, DNA may also comprise the nucleobase deoxyinosine or any other universal nucleobase such as, for example, 5-nitroindole. DNA may further also comprise deoxyuridine bases/nucleotides.

As used herein the terms "universal nucleotide(s)", "universal base(s)" and "universal nucleobases" refer to nucleotides, bases and nucleobases, respectively, that can pair/anneal/hybridize with all four canonical nucleotides/bases/nucleobases A, T, C and G and can thus contribute in stabilizing the interaction between the two strands of double stranded DNA. In the context of the invention in principle any universal nucleotides/bases/nucleobases known in the art may be employed. Preferred universal nucleotides/bases/nucleobases that may be employed in the context of the invention are deoxyinosine nucleotides/bases/nucleobases or 5-nitroindole nucleotides/bases/nucleobases. Particularly preferred are deoxyinosine nucleotides/bases/nucleobases.

As used herein a "reaction compartment" refers to any compartment that allows separated incubation of solutions/solid supports. For instance, a reaction compartment may be a microtiter plate well, preferably the well of a 96-well microtiter plate.

When referring to a predefined set A of oligonucleotides, this means that the sequences are purposefully designed. The oligonucleotides preferably have the same length and the same sequence with the exception of the barcode segment A. In particular, the barcode segment A is preferably of the same length in all oligonucleotides of set A. For the barcode segment A, a pairwise difference in at least two nucleotide positions (e.g. exactly two nucleotide positions) is preferred so that error detection and correction on a barcode segment level (as described elsewhere herein) is possible. Preferred barcode sequences that may be employed are described elsewhere herein (even if described in a different context the barcode sequences may be applied mutatis mutandis).

When referring to a predefined set of polynucleotides B, this means that the sequences are purposefully designed. Specifically, the single stranded section is designed such that it is reverse complement to the free end of the oligonucleotides of set A. The barcode segment B is placed directly next to the single stranded section. It is again preferred that polynucleotides B are preferably identical in sequence with the exception of the barcode segment B. For the barcode segment B, which is of the same length in all polynucleotides of set B, it is preferred that the sequence differs in at least two base pair positions (e.g. exactly two base pair positions). This preferred configuration allows for error detection and correction on a barcode segment level (as described elsewhere herein). Preferred barcode sequences that may be employed are described elsewhere herein (even if described in a different context the barcode sequences may be applied mutatis mutandis).

In step c) of the method, the strand comprising the universal nucleotides is removed. The exonuclease to be used is either a 5' to 3'-exonuclease or a 3' to 5'-exonuclease depending on the strand orientation. The strand orientation is defined by the end of the oligonucleotides selected of set A which is attached to the solid supports. If the 5' end is attached, a 5' to 3'-exonuclease has to be used. If the 3' end is attached, a 3' to 5'-exonuclease has to be used. Preferred exonucleases are mentioned elsewhere herein.

In one embodiment, the method of the invention may further comprise washing the solid supports in each of the reaction compartments after steps b) and/or c). Washing may mean one or more washing steps. For instance, a wash buffer comprising or consisting of 50 mM NaCl, 30 mM Tris pH=8 and 0.1% Triton X-100 may be employed.

The double stranded section of the polynucleotides of set B may further comprise a type IIS restriction enzyme recognition site. The recognition site is positioned so that a type IIS restriction enzyme cuts at the end of the barcode segment B so that the barcode segment remains attached to the solid support (e.g., when the single stranded segment is 5' of the barcode segment B, the cut is at the 3' end of the barcode segment). In the embodiments in that the polynucleotides of set B further comprise a type IIS restriction enzyme recognition site, the method may further comprise the following step:

b') digesting the solid support-attached ligation products of step b) with the type IIS restriction enzyme recognizing the type IIS restriction enzyme recognition site so as to remove the double stranded section of the polynucleotides B from the solid supports.

After step b') (and preferably before step c)), a washing step (e.g. using a wash buffer as described above) may be conducted so as to remove the DNA that is removed from the solid supports by the digestion.

In the context of the invention in principle any type IIS restriction enzyme may be employed. Type IIS restriction enzymes are known in the art and are commercially available. The corresponding recognition sequences are known in the art. Furthermore, it is also known in the art where the recognition site must be placed to allow the cut to occur at the desired site. The type IIS restriction enzyme and the corresponding recognition site is preferably selected so that the 5' end of the barcode segment after the digestion remains 5' phosphorylated. The 5' phosphorylation may subsequently be used for the ligation of a further polynucleotide of set C to the solid-support attached DNA assembly resulting from step b'). The following commercially available type IIS enzymes are preferred: AcuI, AlwI, BaeI, BbsI, BbsI-HF, BccI, BceAI, BciVI, BcoDI, BmrI, BpuEI, BsaI, BsaI-HF®, BsaI-HF®v2, BsaXI, BseRI, BsgI, BsmAI, BsmBI, BsmFI, BspCNI, BspQI, BsrDI, BtgZI, BtsCI, BtsI, BtsIMutI, EarI, EciI, Esp3I, FauI, HgaI, HphI, HpyAV, MlyI, MnlI, SapI, SfaNI. More preferred are the following enzymes: BbsI, BbsI-HF, BsaI, BsaI-HF®, BsaI-HF®v2, BsmBI, BspQI, BtgZI, Esp3I, MlyI, SapI. It is particularly preferred in the context of the invention to employ the type IIS restriction enzyme SapI and its corresponding recognition site or the type IIS restriction enzyme MlyI and its corresponding recognition site.

The method may further comprise washing the solid supports between steps b') and c) once or more (e.g. using the wash buffer as described, above). The method may further comprise pooling or mixing the solid supports after step c). The solid supports may be washed before or after pooling (e.g. using the wash buffer as described above).

In some embodiments, the polynucleotides of set B may comprise an identical sequence stretch of 4 to 50 nucleotides, 6 to 35 nucleotides, or 8 to 19 nucleotides (e.g. 19 nucleotides or 35 nucleotides) at the end of the double stranded section opposite the single stranded section (e.g. if the single stranded section is comprised at the 5' end, at the 3' end of that strand). The method may then further comprise:

d) hybridizing (or annealing) to the single stranded oligonucleotides of step c) an oligonucleotide comprising a sequence being reverse complementary to the sequence of the identical sequence stretch so as to produce a double stranded end. The oligonucleotide which is hybridized (annealed) may comprise a 5'-phosphorylation.

Preferably, the identical sequence stretch comprises a transposase recognition sequence. Preferred transposase recognition sequences are described herein elsewhere and can be applied in this aspect mutatis mutandis. For instance, a ME transposase recognition sequence, preferably a transposase recognition sequence as defined by nucleotide positions 15 to 33 of SEQ ID NO: 9 or nucleotide positions 16 to 34 of SEQ ID NO: 10 may be employed. The hybridization step may then lead to the formation of a transposon. In one embodiment, the transposon may be a minimal transposon in which the generated double stranded section is a minimal transposon sequence. By forming a transposon, the solid supports become useful, e.g. for on-bead tagmentation.

In the context of the present invention any transposase having in vitro transposase activity can be employed. Methods for testing in vitro transposase activity are known in the art. Exemplary methods are described in the appended examples. Preferred transposases and corresponding transposase recognition sequences and minimal transposon sequences are described herein above.

As used herein the term "transposon" refers to a double stranded or preferably partially double stranded DNA which comprises a terminal minimal transposon sequence, said minimal transposon sequence at least including a double stranded transposon recognition sequence. A minimal transposon sequence is a sequence that allows transposition of the DNA in which it is comprised into a target DNA. A transposon comprises a "transfer strand" and a "non-transfer strand". Transposition means that a double strand break is introduced into the target DNA molecule and that the 3' end of the transfer-strand is ligated to a 5' end of the DNA at a DNA double break site. The transfer strand is ligated to the target DNA molecule during transposition, i.e. is transferred. The non-transfer strand is not directly ligated and typically a 9-nucleotide gap remains. Therefore, typically a gap-filling reaction is performed to produce a linkage between the non-transfer strand and the target DNA fragment. The transfer strand of the transposons as used herein has a free 3' end.

A transposon in the context of the present invention may comprise numerous sequence features, such as a sequencing adapter, primer sites, a solid-support linker sequence etc. Preferably, a transposon is only double stranded in the minimal transposon sequence. Preferably, a transposon comprises a single stranded extension on the transfer strand or non-transfer strand. The other sequence features (see above), such as the sequencing adapter are preferably comprised in said single stranded extension. In some embodiments, the transposons may also have single stranded, non-complementary extensions on the transfer and non-transfer strand.

As used herein the term "tagmentation" means the parallel fragmentation and adapter attachment by transposition. The term tagmentation is known in the art and is also frequently used in the art (see, e.g., Zhang et al., Zheng et al., Wang et al., WO 2016/061517 A2 and US 2018/0245069 A1)

As used herein the term "on bead tagmentation" or "on solid support tagmentation", relates to tagmentation of target DNA directly at a surface of a bead or solid supports, respectively. This is preferably achieved by having the transposome complexes including the transposase pre-attached to said surface. The reaction "on bead" or "on solid support" preferably results in the target DNA fragments remaining attached to the solid support or bead.

As used herein, the term "transposome" refers to the complex formed from a transposase and a transposon. Preferably the transposase dimerizes so that a transposome may comprise two transposons that are dimerized via the interaction of the respective transposase molecules attached thereto. The dimer may preferably be a heterodimeric regarding the transposons. For example, a transposome may comprise a first transposon and a second transposon.

Optionally, the identical sequence stretch may also comprise the type IIS recognition site.

The production method may further comprise after step c) the attachment of a third barcode segment C.

Accordingly, the method may comprise the steps of pooling the solid supports as generated in step c) (and optionally washed) and subsequently d) distributing the pooled solid supports into a plurality of reaction compartments; and e) ligating in each of the reaction compartments of d) a polynucleotide selected from a set of predefined polynucleotides C to the free end of the solid support-attached single-stranded oligonucleotides; and optionally f) removing the strands originating from the single stranded section from the solid supports by exonuclease digestion so as to generate on the solid supports single stranded oligonucleotides comprising a barcode segment A, a barcode segment B and a barcode segment C, wherein the barcode segments A and B are directly linked to each other and the barcode segments B and C are directly linked to each other.

The double stranded section of the polynucleotides of set C comprise a barcode segment C positioned directly at the end facing the single stranded section, wherein the polynucleotides of the set C differ in the sequence of the barcode segment C, preferably by at least two base pairs.

The polynucleotides of the set C comprise a double stranded section and a single stranded section (in other words have a double stranded structure with a single stranded overhang on one end formed by one of the two strands). The single stranded section is reverse complementary to the free end of the solid support-attached single-stranded oligonucleotides produced in step c) and comprises universal nucleotides (e.g., deoxyinosine nucleotides/bases or 5-nitroindole nucleotides/bases) at the positions being reverse complementary to the barcode segments A and B. The single stranded section comprises further at least 6, at least 8, at least 10 or at least 12 (reverse complementary) nucleotides other than the universal nucleotides (preferably at most 10, at most 12, at most 14, at most 16 or at most 18 (reverse complementary) nucleotides other than the universal nucleotides). These further nucleotides are preferably reverse complementary to the sequence directly next to the barcode segment A. The universal nucleotides can hybridize with any other nucleotide, i.e. any barcode sequence. They pair with any barcode segment sequence and allow simultaneous ligation to all barcode segment A and B sequences.

When referring to a predefined set of polynucleotides C, this means that the sequences are purposefully designed. Specifically, the single stranded section is designed such that it is reverse complement to the free end of the solid support-attached DNA assembly, i.e. to the terminal barcode segments A and B and a sequence segment of 5, preferably 10 nucleotides upstream thereof. Complementary to the barcode segments that vary in sequence is achieved by universal nucleotides/bases (e.g. deoxyinosine nucleotides/bases or 5-nitroindole nucleotides/bases). It is again preferred that polynucleotides C are identical in sequence with the exception of the barcode segment C. For the barcode segment C, which is preferably of the same length in all polynucleotides of set C, it is preferred that the sequence differs in at least two base pair positions (e.g. exactly two base pair positions). This preferred configuration allows for error detection and correction on a barcode segment level (as described elsewhere herein). Preferred barcode sequences that may be employed are described elsewhere herein (even if described in a different context the barcode sequences may be applied mutatis mutandis).

The polynucleotides of set C preferably comprise an identical sequence stretch of 4 to 50 nucleotides, 6 to 35 nucleotides, or 8 to 19 nucleotides (e.g. 19 nucleotides or 35 nucleotides) nucleotides at the end of the double stranded section opposite the single stranded section. The method may then further comprise:

g) hybridizing to the single stranded oligonucleotides of step f) an oligonucleotide comprising a sequence being reverse complementary to the sequence of the identical sequence stretch so as to produce a free double stranded end. The oligonucleotide which is hybridized (annealed) may comprise a 5'-phosphorylation.

Again, the identical sequence may comprise a stretch that comprises a transposase recognition sequence. Any of the transposase recognition sequences mentioned herein elsewhere may be employed. Preferably, a ME transposase recognition sequence is employed. Even more preferably a transposase recognition sequence as defined by nucleotide positions 15 to 33 of SEQ ID NO: 9 or nucleotide positions 16 to 34 of SEQ ID NO: 10 may be employed. Employing a transposase recognition site and the hybridization step allows the formation of a transposon, as e.g. used for on bead tagmentation.

The method of producing barcoded solid supports may further comprise producing the solid supports by attaching the oligonucleotides of set A to the solid supports. Optionally, when two or more different oligonucleotides of the set of oligonucleotides A are used, each of the different oligonucleotides may be attached in separate reaction compartments. This ensures that only multiple identical copies of the same oligonucleotide are attached to each solid support. After attachment the beads may be pooled (and mixed) and distributed into multiple reaction compartments so that the solid supports in the reaction compartments of step a) are provided.

In one embodiment the solid supports contained in a first of the reaction compartments in a) may differ from the solid supports contained in a second of the reaction compartments in a) in that the barcode segment A differs in its sequence between the attached oligonucleotides of set A, preferably by at least two nucleotides. In one embodiment, the solid supports of the different reaction compartments may differ from each other in that the barcode segment A of the attached single stranded oligonucleotides differs in its sequence, preferably by at least two nucleotides.

The barcode segments A, B and C are preferably barcode segments as described herein elsewhere. The barcode segments A, B and C may have the same or different length. Each of the barcode segments A, B and C has a preferred length of 4 to 9 nucleotides or base pairs (e.g. 4, 5, 6, 7, 8 or 9). Preferably the barcode sequence A has a length of 4 to 9 nucleotides. The barcode segment B has preferably a length of 4 to 9 base pairs. The barcode segment C has preferably also a length of 4 to 9 base pairs.

The ligation in step b) and/or step e) of the production method may be performed with different ligases, such as, for example a Quick ligase or a TA ligase (such as Blunt/TA ligase). The present inventors found that a TA-ligase, preferably a Blunt/TA ligase (e.g., available from NEB as Blunt/TA ligase Mix, M0367) is particularly suitable and allows highly efficient ligation (see appended Examples).

As explained above, the method of producing DNA barcoded solid supports is particularly suitable for generating solid supports for on bead tagmentation and/or sequencing approaches. Thus, the oligonucleotides of the set A may be configured so that they comprise a common sequencing adapter A1 (i.e. comprised in the same sequence at the same position of the set A oligonucleotides) between the attachment site and the barcode segment A. The adapter sequence A1 preferably comprises a first sequencing library amplification primer site, such as for a P5 or P7 primer as described elsewhere herein.

As mentioned above, the oligonucleotides of set A attached to the solid supports are all attached to the solid supports via the same end.

The attached end may be the 5' end of the oligonucleotides A. Accordingly, each of the oligonucleotides may be attached to one of the solid supports via its 5' end. In the embodiments using a 5' end attachment of the oligonucleotides of set A to the solid supports, the polynucleotides of set B and/or set C may be 5' phosphorylated, preferably at the strand not forming the single stranded extension. This 5' phosphorylation facilitates ligation. Further, in the embodiments using a 5' end attachment to the solid supports, the exonuclease employed in step c) and/or step f) is a 3' to 5'-exonuclease. Preferred 3' to 5'-exonuclease are Exo III, Thermolabile Exonuclease I, Exonuclease T, Nuclease BAL-31, all of which are commercially available. The most preferred 3' to 5'-exonuclease is Exo III.

The attached end may be the 3' end of the oligonucleotides A. Accordingly, each of the oligonucleotides may be attached to one of the solid supports via its 3' end. In the embodiments using a 3' end attachment of the oligonucleotides of set A to the solid supports, the polynucleotides of set B and/or set C may be 5' phosphorylated, preferably at the strand not forming the single stranded extension. This 5' phosphorylation facilitates ligation. Further, in the embodiments using a 5' end attachment to the solid supports, the exonuclease employed in step c) and/or step f) is a 5' to 3'-exonuclease. Preferred 5' to 3'-exonuclease are λ exonuclease, Exonuclease VIII, truncated, T7 Exonuclease, all of which are commercially available. The most preferred 5' to 3'-exonuclease is λ exonuclease.

The attachment of the oligonucleotides of set A to the solid support may be mediated by a binding pair. Any of the binding pairs for the attachment to solid supports explained herein elsewhere may be employed. For instance, a binding pair may be selected from biotin-avidin and biotin-streptavidin and one member of the binding pair may be attached at the solid support-attached oligonucleotide end. Alternatively, the oligonucleotides may also be covalently linked to the solid supports as described herein elsewhere.

The oligonucleotides of set A may further have a solid support linker sequence at the solid support-attached oligonucleotide end. Preferred solid support linker sequences (e.g. poly T-linker sequences of a length of 35 or 36 Ts) are described herein elsewhere and may be employed mutatis mutandis.

The method production method may further comprise attaching to each of the solid supports multiple copies of a second barcoded (preferably segmented barcodes) polynucleotide. The polynucleotide may be different for each of the solid supports in a certain reaction compartment. Attaching a second polynucleotide allows further expanding the barcode diversity. Moreover, if the assembled polynucleotides solid supports comprising a solid support-specific set of transposon can be generated (e.g. as the mixture of solid supports provided by the present invention).

Accordingly, the method may further comprise the following steps subsequent to pooling or mixing the beads of step f) and optionally washing the same (e.g., with the wash buffer specified above):

h) distributing the produced solid supports into a plurality of different reaction compartments; and i) attaching to each of the solid supports in each reaction compartment multiple copies of a second barcoded polynucleotide, preferably a second transposon.

Preferably in each of the plurality of reaction compartments a differently barcoded polynucleotide is attached.

The second barcoded polynucleotides may be assembled as described for the first barcoded polynucleotides mutatis mutandis.

Thus, first multiple identical copies of a single stranded oligonucleotide of a predefined set A' may be attached to each of the solid supports via their 5' or 3' end. Specifically, the copies of the oligonucleotide of set A' attached to a single solid support are identical. Other solid supports in the same reaction compartment may have another oligonucleotide of set A attached thereto in multiple copies.

The oligonucleotides of set A' may have a similar configuration as the oligonucleotides of step A. Accordingly, what has been said above for the set A applies mutatis mutandis. Thus, the oligonucleotides of set A' also comprise a barcode segment A' at the non-solid support attached end.

The second polynucleotides may then be stepwise assembled by the method steps as for the first barcoded polynucleotide comprising the barcode segments A and B (and optionally C) with the only exception that the polynucleotide set B' is used instead of the predefined polynucleotide set B. Further, optionally a predefined polynucleotide set C' may be employed instead of the predefined polynucleotide set C.

The set B' of polynucleotides may be identical with the set B of polynucleotides. Similarly, also the set C' of polynucleotides may be identical with the set C of polynucleotides. Alternatively, the set B' of polynucleotides may be identical with the set B of polynucleotides with the exception that the barcode segments are different in sequence (e.g., in length and/or sequence). Similarly, alternatively the set C' of polynucleotides may be identical with the set C of polynucleotides with the exception that the barcode segments are different (e.g., in length and/or sequence).

In one embodiment the sequences of the oligonucleotide set A' may comprise a sequencing adapter A2 between the attachment site and the barcode segment A'. Preferably the adapter sequence A2 may comprises a second sequencing library amplification primer site. Preferred primer sites are the P5 or P7 primer site. The primer site is preferably different than in the adapter sequence A1. For instance, the P5 primer site may be used in one adapter sequence and the P7 primer site may be used in the other adapter sequence so as to allow library amplification with the P5 and P7 primers. Yet, any other primer pair binding sites that allow for library amplification may be employed.

As mentioned above, the method for producing barcoded solid supports is preferably a method for producing the mixture of solid supports according to any one of items 1 to 24 in the following. Thus, the sequences of the oligonucleotide sets and polynucleotide sets are preferably configured accordingly and as described elsewhere herein. Exemplary oligonucleotides sets A (also referred to as universal-anchor primers or universal anchor(s) herein), polynucleotide sets B and polynucleotide sets C are provided in the appended examples, in particular in Examples 14 and 15.

Accordingly, in one embodiment of the method, the finally assembled polynucleotide(s) on the solid supports may be transposons, such as heterodimeric transposons. In the embodiments where transposons are produced, the method may further comprise binding a respective transposase to the transposon end. Transposases and corresponding recognition sequences that are preferably employed are described herein elsewhere. The respective disclosure applies here mutatis mutandis. Particularly preferred is a Tn5 transposase and a corresponding minimal transposase binding site.

Between each of the steps of the method of the invention optionally one or more washing steps may be performed. An exemplary washing buffer is described herein above and in the appended Examples. In particular, it is envisaged that the method comprises as last step(s) pooling the generated solid supports and/or collecting the generated solid supports. The collection may comprise washing.

The polynucleotides of set B and/or set C as well as any other double stranded or partially double stranded DNA as used herein may be assembled by annealing two reverse complementary single stranded oligonucleotides corresponding to the respective strands of the double stranded or partially double stranded DNA. The annealing may involve heating to 95° C. for at least 1 min, preferably at least 2 min (i.e. minutes; e.g. exactly 2 min) and then gradually cooling to a temperature of 40° or lower (e.g. 30° C.) over 30 to 65 cycles (e.g. 65 cycles) of 1 min, e.g., with a decrease of 1° C. per step.

The method according to this aspect of the invention is preferably used for producing a mixture of solid supports as specified in more detail below.

A further key contribution of the present invention is to provide solid supports with a novel and inventive transposon design, wherein each solid support comprises multiple copies of a pair of transposons having a unique (i.e. specific to that individual solid support) DNA barcode tag. As used herein the term "DNA barcode tag" or "barcode tag" relates to the combined barcode sequence information derived from the barcode sequence B1 and the barcode sequence B2.

Both the first and the second transposon of such pair of transposons comprise sequencing adapters with a barcode sequence. This allows generating tagmentation fragments having a first barcode sequence resulting from transposition of the first transposon on the one end of a target DNA fragment and a second barcode sequence resulting from transposition of the second transposon at the second end of a target DNA fragment by on bead tagmentation. This allows reducing the length of the individual barcode sequences to a length of 25 nucleotides or less, which is compatible with placing the barcode sequences in well-established and commonly used indexing positions used in other sequencing library generation strategies (e.g. Nextera®). Positioning the barcode sequences B1 and B2 in indexing positions in turn allows determining the sequence of the barcode sequences without the need for custom design and contributes to a better compliance of multiplexed sequencing including on the same lane with differently generated sequencing libraries. Both the barcode sequences of the first transposons and the barcode sequences of the second transposons attached to the solid supports are segmental, i.e. comprise from 2 to 4 barcode segments. A major gist of the invention is that the sequences of each of the at least four barcode segments comprised in the two barcode sequences are selected such that the sequence allows for error detection and/or correction on a barcode segment level. This is achieved by employing nucleic acid sequences that differ from each other in at least two, preferably three nucleotide positions. Having in total at least four different barcode segments of a length of 4 to 9 nucleotides allows extremely high barcode diversity with millions to billions of different barcodes depending on the numbers and lengths of barcode segments within the barcode sequences. Using short barcode segments each of them in itself being suitable for bioinformatic error detection and correction allows extremely efficient, accurate and fast error detection and correction that requires low computer capacity. The advantage of using short barcode segments is also that the barcodes that cannot be correctly assigned due to errors in synthesizing and sequencing such barcodes is significantly lower than when synthesizing a non-segmented longer barcode sequence that allows similar diversity. Thus, the strategy of using error-correcting barcode segments is advantageous to previous approaches which used either longer non-segmented barcode sequences and/or barcode sequences that are not specifically designed for error detection and correction. It is in particular advantageous to reduce barcode loss resulting from sequencing errors and/or synthesis errors in the barcode sequence. In the end, this contributes to the high accuracy and good performance of the mixture of solid supports in on bead tagmentation approaches for libraries generated for linked read sequencing using short read sequencing methods, such as Illumina® based sequencing methods. The power and accuracy in generating sequencing libraries that can be achieved by using the mixture of solid supports of the invention in linked read sequencing and haplotyping approaches is illustrated in the appended Examples, in particular Example 10. A key practical advantage of the method also referred to as "hap-lotagging", is its ease of use, high multiplexing capacity and, thus, low costs. This is shown in appended Table 7, which summarizes typical operating costs (excluding one-time costs for, e.g., sequencing instruments) for preparing sequencing libraries with conventional short-read sequencing (TruSeq), Tn5-based Nextera® short-read sequencing, 10× Genomics Chromium linked-read sequencing or "hap-lotagging". It shows that haplotagging has comparable costs to Tn5-based approaches and is about 100 times cheaper than the commercially available Chromium linked-read sequencing platform, while delivering superior performance (see Table 6) in a shorter time and involving less complex protocols.

The standard Illumina® indexing reads have a length of 8 nucleotides which would have produced only around 727 such error-correcting barcodes. Currently Illumina® only offers 96 combinations for 8 nucleotide barcodes. Even if both i7 and i5 indexing reads were to be used in combination as a "bi-code" with the 727 error-correcting barcodes, it can only generate 528,529 (727×727) combinations, an insufficient diversity, before considering further sample multiplexing. This problem has been addressed by increasing the barcode sequence length to up to 25 nucleotides. The inventors have found that barcode sequences of such length are still compatible with parallel sequencing of DNA libraries having shorter indexing reads on the same lane of the sequencer. Notably, in particular Illumina HiSeq® instruments are already pre-configured to support reading 12 and 13 nt of indexes without any customization of the Illumina® sequencing run recipe. Longer indexing reads up to 25 nucleotides can also easily be achieved if enough material such as primers and reaction mix is provided and minor amendments to the run protocol (e.g. increasing the cycle number to 25) are made. Thus, positioning the segmented barcode sequences provided by the present invention in the standard Illumina® indexing positions is feasible and allows using these barcodes simultaneously for preserving contiguity information of the target DNA and for multiplexing with other libraries on the same lane.

As used herein the term "maintaining the contiguity of the target nucleic acid" in the context of fragmenting a target DNA means maintaining the order of the nucleic acid sequence of the fragments from the same target DNA. Moreover, the term is also used herein interchangeable with the term "preserving contiguity information of the target DNA".

Using the segmented barcode structure with rather short total length and the positioning of these segments in the standard indexing reads greatly increases barcode diversity while retaining robust decoding ("demultiplexing"). By the use of multiple short barcode segments, also the design of the barcode sequences gets much easier and requires much less computational time for demultiplexing. Due to the complexity of designing larger, non-segmental barcode sequences algorithms for barcode generation are themselves the subject of multiple scientific research papers, because even for barcodes with as few as 10 nt, it can take significant computational time to generate (and possibly demultiplex) error-correcting barcodes (Buschmann Bystrykh BMC Bio-informatics 2013 14:272; Hawkins et al. 2018 PNAS 115:27, doi: 10.1073/pnas.1802640115). This is because for each candidate barcode, it has to be scored against all available combinations for potential overlap, and this becomes increasingly computationally difficult as the barcode length increases. This is solved by the present invention that performs this analysis for the barcode sequence design and the demultiplexing on a barcode segment level thereby reducing complexity dramatically.

The segmented barcode structure employed by the present invention is advantageous in sequencing methods, in particular when it comes to downstream bioinformatic analysis therefrom. The error-correcting barcode sequences used for each barcode segments allow the error detection and correction to be performed on a barcode segment level, which significantly accelerates the analysis and minimizes the computational power required. The present invention provides also a computer implemented method and a corresponding computer program product that can perform the demultiplexing and error detection and correction of the barcode sequences on a barcode segment level. This method and program can also combine the segmental data to the overall barcode tag information.

In a preferred embodiment the present invention describes transposon having barcoded sequencing adapters A1 and A2 that follows the popular Nextera® format and are fully compatible therewith. The major exception is the new segmental barcode design which provides the capacity of introducing millions to billions of barcode combinations while still being compatible with the indexing read protocol of standard Nextera® libraries. Such configuration allows running sequencing samples generated by the means and methods of the present invention on the same lane with Nextera® libraries, or in the same flow cell with other Nextera® or TruSeq® libraries. The multiplexing capability with other samples can save time and costs.

The present invention further provides new and inventive methods for generating a mixture of solid supports (for on-bead tagmentation). The methods for assembling the barcoded transposons on the solid supports involve the assembly by a split-and-pool ligation strategy. The inventors found that the split-and-pool ligation strategies of the methods of the invention are highly efficient and allow the production of a segmented barcode structure without a linker sequence between the individual barcode segments or only with linker sequences being as short as one or two nucleotides in length. By limiting the linker length, the length of one or both of the barcode sequences can be kept as short as 8 nucleotides with two barcode segments of 4 nucleotides in length.

Keeping the length of the barcode sequences short allows also for positioning of the segmented barcode sequences in common indexing positions used in other sequencing library setups, such as, e.g., the i5 and i7 indexing positions used in Illumina® sequencing approaches for multiplexing. Thus, the barcodes can serve a dual function: (i) preserving the information about target DNA contiguity and (ii) being an index for multiplexing of different sequencing libraries on a single sequencing lane. Further, limiting the length of barcodes to fit "index reads" while keeping maximum barcode diversity is also advantageous versus "in-line" positioning of a barcode, because in line barcode positioning takes away sequencing throughput. However, also when using "in line" positioning of a barcode sequence with the target DNA fragment, a short barcode length helps to keep loss of read length for the target DNA at a minimum. In the prior art such as US 2018/0195112 A1 or WO 2016/168351 A1 these constraints were not taken into consideration. For example, herein means and methods are disclosed to deliver errorproof robustness in the barcodes within 18 nt total sequence with 0 to 2 nt intervening sequences, consistent with the general constraint of up to 25 nt of indexing sequence. In contrast, according to the disclosure of WO 2016/168351 A1 sequence segments S1 and S2 are up to 12 nt, or up to 15 nt long to allow annealing for primer extension. This would add at least 24 nt to the whole barcode sequence, which alone would have taken up the entire available number of indexing cycles for example in an Illumina® sequencing application. The same applies to the barcode configuration described in Wang et al. (loc. cit), wherein long intervening segments are disclosed for annealing as well. Again, this would render the libraries impractical or unusable in standard commercial sequencing applications.

The method of producing a mixture of solid supports of the invention comprises the stepwise split-and-pool ligation of oligonucleotides, each comprising a barcode segment, employing only extremely short complementary overhangs of 2 or less nucleotides or even without linker sequencing remaining in the final barcode sequences. It is of note that previously described split-and-pool assembly strategies to generate beads bead-specific barcoded polynucleotides, such as reported in Zhang et al. (loc. cit.), Wang et al. (loc. cit.) and Cheng et al. (loc. cit.), employed linker sequences of at least 6 base pairs in length. Using longer overhangs results in disadvantageous longer total barcode regions. Due to the high and nearly complete ligation efficiency required for the individual ligation reactions in split-and-pool assembly approaches, these previous studies employed much longer overhangs/overlaps for ligation of the individual polynucleotides probably assuming that shorter overhangs would not work efficiently. The present inventors could surprisingly show that highly efficient ligation in a split-and-pool assembly is feasible, even when using only a single nucleotide overhang or can be performed without remaining linker sequences. Especially, also ligation using single nucleotide A and T 5' overhangs, respectively, could be employed by using TA-ligase. The appended Examples demonstrates that despite doubts in the field, split-and-pool assembly of barcoded oligonucleotides/transposons is achievable with using only a one or two nucleotide complementary overhangs (see in particular Examples 7 and 10). The present inventors have further developed another ligation strategy allowing for ligation with the required efficiency (i.e. nearly complete ligation). This strategy uses overhangs but the ligation is achieved by a strategy that prevents any of such linker sequences being present in the assembled barcode segments (see Examples 14 and 15). The barcode segments can thus even be directly linked without linker sequences. This is particularly desirable, because it shortens the overall length of the segmented barcodes even further and increases the flexibility of positioning the barcode sequence. Moreover, shorter barcode sequences reduce production costs.

All in all, the present invention provides a combined solution for achieving extremely high barcode diversity with a minimal barcode length and allowing for highly efficient demultiplexing and error detection and correction. Thus, the barcode design of the invention provides for a high diversity, a rapid and error-tolerant decoding; and a simple and reliable synthesis procedure. This barcode sequence design allows in turn for a highly effective, easy to use and accurate linked read sequencing using short read sequencing technologies. The present invention employs the inventive strategy to concatenate at least two segments of shorter error-correcting barcode segments of moderate diversity to a barcode sequence. For instance, 6 nt barcode segments of up to around different 96 combinations, which results in 884,736 error-tolerant combinations for 3 segments (96×96×96), or 84,934,656 combinations for 4 segments (964) may be employed for the barcode sequences employed in the present invention. By varying the linker sequence lengths between the barcode segments (e.g., by varying the overhang position during ligation), the diversity can be further increased to 14,155,776 (963×4×4) for 3 segments and to about 1.4 billion combinations for 4 segments (1,358,954,496, or 964×4×4). The high diversity being based on combinatorial combination of short barcode segments has the dual advantage of ensuring easy demultiplexing due to breaking a long barcode into short, manageable segments while ensuring that it is easy and simple to be designed computationally synthesized biochemically and to be demultiplexed computationally.

In a further aspect, the present invention relates to a mixture of solid supports comprising at least one million solid supports. In a preferred embodiment the mixture of solid supports consists of the at least one million solid supports. Each of said at least one million solid supports comprises multiple identical copies of a solid support-specific set of two transposons, wherein each solid support-specific set of two transposons comprises a DNA-barcode tag that distinguishes the solid support from all other solid supports of the at least one million solid supports. The first transposon of each set of two transposons comprises an adapter sequence A1 for sequencing library generation within one of its strands and the second transposon of each set of two transposons comprises an adapter sequence A2 for sequencing library generation within one of its strands, wherein the one strand of the first transposon comprising adapter sequence A1 and the one strand of the second transposon comprising the adapter sequence A2 are both the transfer or the non-transfer strand of the respective transposon. Preferably, both the adapter sequence A1 and the adapter sequence A2 are placed on the transfer strand of the respective transposons. The first transposon and the second transposon of each set of two transposons are configured such that a transposase can bind to the transposon end at which the 3'end of the transfer strand is positioned. The non-transfer strand of the first transposon and the non-transfer strand of the second transposon of each set of two transposons are 5' phosphorylated.

The solid-support-specific DNA barcode tag of each solid support of the at least one million solid supports consists of a first barcode sequence B1 comprised in the adapter sequence A1 and a second barcode sequence B2 comprised in the adapter sequence A2. In total (i.e. over the full set of at least one million solid supports), there are in total m different barcode sequences B1 resulting in m different sequencing adapters A1, wherein m is a positive integer. Said m different sequencing adapters A1 differ only in the barcode sequence B1 but are otherwise identical. Moreover, there are in total (i.e. over the full set of at least one million solid supports) n different barcode sequences B2 resulting in n different sequencing adapters A2, wherein n is a positive integer. Said sequencing adapters A2 differ only in the barcode but are otherwise identical. The m different barcode sequences B1 are of the same length, preferably being selected from 8 to 25 nucleotides and have a segmented barcode structure comprising z barcode segments, wherein the segmented barcode structure of the m different barcode sequences is the same regarding the number z, the positioning and the lengths of the z barcode segments. The number z of barcode segments within each of the barcode sequences B1 is a positive integer greater than two, preferably 2, 3 or 4. Each of the z barcode segments preferably has a length of 4 to 9 nucleotides. The n different barcode sequences B2 are also of the same length, preferably being selected from 8 to 25 nucleotides and have a segmented barcode structure comprising g barcode segments, wherein the segmented barcode structure of the g different barcode sequences is the same regarding the number g, the positioning and the lengths of the g barcode segments. The number g of barcode segments within each of the barcode sequences B2 is a positive integer above 2, preferably 2, 3 or 4. Preferably each of the g barcode segments has a length of between 4 and 9 nucleotides. The nucleic acid sequence of each of the z barcode segments of the barcode sequences B1 is selected from a set (or group) of predefined barcode nucleic acid sequences that is assigned to the respective barcode segment (e.g., the first, the second, and optionally the third and optionally the fourth of the z barcode segments, respectively). Each of the assigned sets of the in total z predefined sets of barcode nucleic acids comprises a positive integer of different barcode nucleic acid sequences, wherein the positive integers of different barcode nucleic acid sequences assigned to the respective barcode segments of the barcodes B1 are defined as $x_1$ to $x_z$, wherein $x_1$ is the number of different barcode nucleic acid sequences of the set assigned to the barcode segment positioned closest to the first end (preferably the end being closer to the attachment site of the first transposon to the solid support) of the barcode sequence B1 and $x_z$ is the number of different barcode nucleic acid sequences of the set assigned to the barcode segment positioned closest to the second end of the barcode sequence B1 (preferably the end being more distant from the attachment site of the first transposon to the solid support). Further, the nucleic acid sequence of each of the g barcode segments of the barcode sequence B2 is selected from a set of predefined barcode nucleic acid sequences that is assigned to the respective barcode segment (e.g., the first, second, and optionally the third and optionally the fourth of the z barcode segments, respectively), wherein each of the assigned sets of the in total g predefined sets of barcode nucleic acids comprises a positive integer of different barcode nucleic acid sequences, wherein the positive integers of different barcode nucleic acid sequences assigned to the respective barcode segments of the barcodes B2 are defined as $k_1$ to $k_g$, wherein $k_1$ is the number of different barcode nucleic acid sequences of the set assigned to the barcode segment positioned closest to the first end of barcode sequence B2 and $k_z$ is the number of different barcode nucleic acid sequences of the set assigned to the barcode segment positioned closest to the second end of the barcode sequence B2.

The values of the numbers z and $x_1$ to $x_z$ define the number m of different barcode sequences B1 as expressed by the following mathematical formula:

$$\prod_{i=1}^{z} x_i = m$$

The values of the numbers g and $k_1$ to $k_g$ define the number n of different barcode sequences B2 as expressed by the following mathematical formula:

$$\prod_{i=1}^{g} k_i = n$$

Each of the predefined sets of nucleic acid sequences for the barcode segments consists of at least two nucleic acid sequences that pairwise differ from each other in at least two nucleotide positions, preferably at least three (e.g., exactly three) nucleotide positions. The values of the numbers z, $x_1$ to $x_z$, g and $k_1$ to $k_g$, are selected such that $m \times n \geq 1 \times 10^6$, i.e. there are in total at least one million unique DNA barcode tags available for the at least one million solid supports. There are numerous different combinatorial combinations how $m \times n \geq 1 \times 10^6$ can be achieved. A skilled person can select from such combinatorial combinations by defining the numbers z, $x_1$ to $x_z$, g and $k_1$ to $k_g$ accordingly. The skilled person will also be aware that selecting the barcode segment lengths influences m and/or n in that it predefines the maximum number of barcode nucleic acid sequences differing by at least two, preferably three nucleotides, i.e. predefines the maximum value for $x_1$ to $x_z$ and/or and $k_1$ to $k_g$. respectively. Exemplary barcode sequences with the exemplary length of 6 nucleotides are provided herein below and are employed in the appended Examples.

Figure 19:
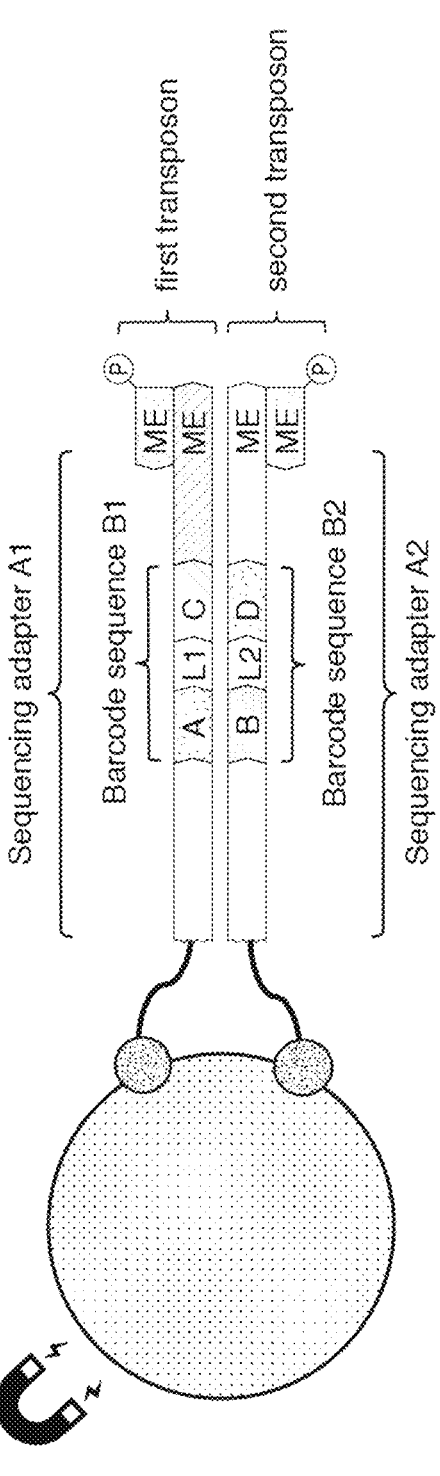
Figure 19:
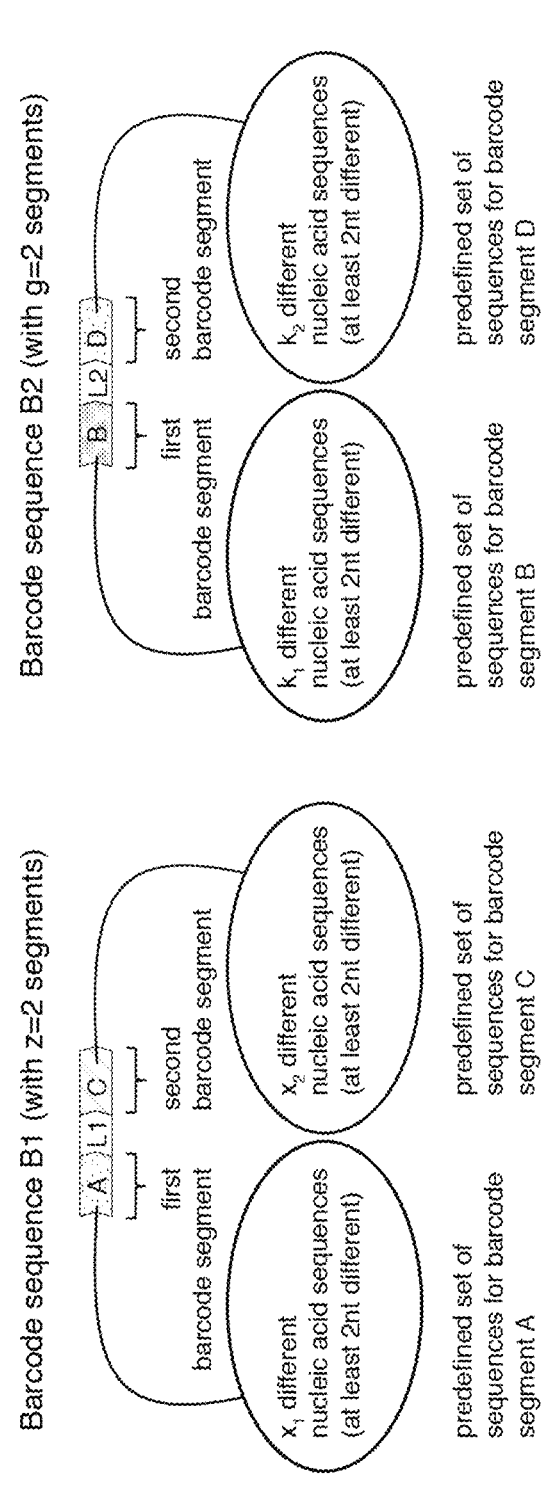

A schematic drawing illustrating the structural configuration of the solid supports of the mixture of solid supports of the present invention is visualized in FIG. 19. The drawing exemplifies the configuration of the solid supports by depicting a single solid support in the exemplary form of a microbead and showing the overall configuration of a bead-specific set of first and second transposons. The drawing is simplified in that it only shows a single pair of first and second transposons. In fact, however, multiple identical copies of the same solid support-specific transposon pairs are bound to the solid support. Preferred numbers and methods for determining the ideal transposon number and density for efficient on bead tagmentation are described herein below and in the appended Examples.

The mixture of beads of the present invention is in particular characterized in that the barcodes B1 and B2 have a segmented structure and in that the predefined sets of nucleic acid sequences for the barcode segments consists of at least two nucleic acid sequences that pairwise differ from each other in at least two nucleotide positions, preferably three or more positions. The pairwise difference in at least two, preferably three nucleotides in combination with the use of a predefined sequence set allows for bioinformatical error detection and correction on a barcode segment level rather than over the complete barcode tag. Allowing for error detection and correction on a barcode segment level is linked to a number of advantages as discussed herein and as illustrated by the appended Examples.

The first transposon and the second transposon of each set of two transposons are configured such that a transposase can bind to the transposon end at which the 3'end of the transfer strand is positioned. The transposase binding is preferably achieved in that the transfer strand of the first and the second transposons comprise a transposase recognition sequence (such as a minimal transposon sequence) at the 3' end and that the non-transfer strands comprise the reverse complementary transposase recognition sequence at the 5' end. Transposase recognition/minimal transposon sequences are known in the art and are, for example, describe in Reznikoff, Mol Microbiol. 2003 47 (5): 1199-206. The (minimal) transposase recognition sequence is preferably an ME transposase recognition sequence. The ME transposase recognition sequence may have the sequence as defined from nucleotide position 15 to 33 in SEQ ID NO: 9 or positions 16 to 34 in SEQ ID NO: 10. Having a transposase recognition sequence in the solid-support attached transposons has the advantage that transposase can be bound directly without an error-prone hybridization, as for example employed by Zhang et al. (loc. cit.) and WO 2016/061517 A2. In principle, although less preferred, the hybridization technology as described in Zhang et al. (loc. cit.) and WO 2016/061517 A2 (both are herein incorporated by reference in its entirety and in particular with respect to the transposase hybridization embodiment) may be used. The "transposons" can in such embodiments be referred to as "transposon-capture oligonucleotides", because the minimal transposon sequence is not comprised in the solid-support attached oligonucleotides but is instead bound to the transposase.

The adjacent barcode segments of the z barcode segments of each of the barcode sequences B1 of the first transposons may be connected directly or by a linker sequence L1. The linker sequence L1 preferably has a length of less than six, less than four, less than three, less than two nucleotides and most preferably only one nucleotide. Shorter linker sequences are preferred. The linker sequences may be the same in length and/or sequence or different in length and/sequence between the z barcode segments (e.g., the linker sequence between the first and second barcode segment may be the same or different from the linker sequence between the second and third barcode segment). Similarly, the adjacent barcode segments of the g barcode segments of each of the barcode sequences B2 of the first transposons may be connected directly or by a linker sequence L2. The linker sequence L2 preferably has a length of two nucleotides or less, most preferably only one nucleotide. The linker sequences may be the same in length and/or sequence or different in length and/sequence between the z barcode segments (e.g., the linker sequence between the first and second barcode segment may be the same or different from the linker sequence between the second and third barcode segment). Methods for producing such segmented barcodes with a direct linkage or a linker sequence of only one or two nucleotides in length are described in the present application further below and in the appended Examples.

The length of the barcode sequences B1 and B2 is preferably selected from 8 to 25, wherein the length of the barcode sequences B1 and B2 may be the same or different. Preferably, each of the barcode sequences B1 and/or each of the barcode sequences B2 has a length of 8 to 18 or 9 to 18, preferably 8 to 13 or 9 to 13 and most preferably 12 or 13 nucleotides. The barcode sequences B1 and B2 may have the same or a different length. Barcode sequences with such preferred lengths have the advantage that they can be placed in commonly used indexing positions, and, thus, can serve as clonal barcode tags for solid-support based tagmentation approaches and as multiplexing indexes (e.g., when sequencing of libraries generated with the mixture of solid supports is performed on the same lane with differently generated libraries). Further standard indexing read primers and read protocols can be employed when having such a short length of the barcode sequences.

The adapter sequences A1 and A2 may be configured to resemble the sequence of sequencing adapters used in other library preparation protocols such as the standard Nextera® technology. The adapter sequence A1 may comprise the barcode sequence B1 in a first (predefined) indexing position otherwise used for sample multiplexing and the adapter sequence A2 may be configured to comprise the barcode sequence B2 in a second (predefined) indexing position otherwise used for sample multiplexing. In this context the first and the second indexing positions are different. Such predefined indexing positions are known in the art and typically have the purpose that the indexes of different samples can be sequenced with the same indexing read primers. Different indexing positions are known in the art and the adapter sequences A1 and/or A2 can be adapted accordingly so as to comply with the read primers used for the respective indexing positions. A gist of the present invention is to provide short segmented barcode sequences with high diversity that have a length to fit the standard indexing positions. Particularly preferred length ranges that are compatible with placing the segmented barcode sequences in standard indexing positions are 8 to 13 nucleotides or 9 to 13 nucleotides. Most preferred is a length of exactly 12 or 13 nucleotides. This length perfectly fits the i5 and i7 indexing positions and the standard read settings for these indexing positions. The first and second indexing positions are preferably selected from the i5 (nucleotide positions 30 to 37 in SEQ ID NO: 1) and i7 indexing position (nucleotide positions 25 to 32 in SEQ ID NO: 2) as used in the standard Nextera® technology. In principle, also any other known (predefined) indexing position may be employed.

In a preferred embodiment of the invention the number of barcode segments z within each of the barcode sequences B1 is two. Similarly, the number of barcode segments g within each of the barcode sequences B2 may be two. Particularly preferably the numbers z and g are both two. In other words, each of the barcode sequences B1 and/or B2 comprised in the first and second transposon, respectively, may comprise or may be built by two barcode segments (optionally with a respective linker sequence, preferably of one or two nucleotides in length). Corresponding examples of this configuration are shown in appended FIGS. 1 and 19. Similarly, a corresponding example and a method for producing such beads are described in Example 10, herein below.

The numbers of barcode nucleic acid sequences building the predefined sets of barcode nucleic acid sequences can be the same or different for the different barcode segments. In other words, the numbers $x_1$ to $x_z$ and/or $k_1$ to $k_g$ may be all the same or may be different. Also the sequences may be the same or different in at least two or all predefined barcode nucleic acid sequence sets. The maximum number depends on the length, which defines how many sequences fulfill the criteria to differ in at least two or three nucleotide positions. In one embodiment, the number of barcode segments z and g in the barcode sequences B1 and B2 is two. Preferably, each barcode segment may be 6 nucleotides in length. Optionally, at least one barcode segment may be 7 nucleotides in length (optionally with the remaining barcode segments being 6 nucleotides in length). The barcode sequences B1 and B2 may in total be 12, 13 or 14 nucleotides in length. The length may depend on the lengths of the linker sequences L1 and L2, respectively. When employing barcode segments of 6 nucleotides in length, $x_1$, $x_z$, $k_1$ and $k_2$ (and optionally, if present, also $x_3$ to $x_z$ and/or $k_3$ to $k_g$) may be positive integers up to 84 or may all be 84. The values may be the same or different for each predefined set of barcode nucleic acid sequences. The sequences building a predefined set may differ from each other in at least two or preferably in at least three nucleotide positions (e.g., in exactly three nucleotide positions). When employing barcode segments of 6 nucleotides in length, $x_1$, $x_2$, $k_1$ and $k_2$ (and optionally, if present, also $x_3$ to $x_z$ and/or $k_3$ to $k_g$) may also be positive integers up to 96 or may all be 96. These 96 sequences may differ from each other in at least two nucleotide positions (optionally with 84 sequences pairwise differing in at least three nucleotides from each other and 12 differing from the remaining sequences of the 96 sequences in at least two nucleotides). The maximum numbers of barcode nucleic acid sequences that fulfill the criteria of differing in at least three nucleotide positions and/or are suitable for barcode error detection and correction are summarized in table 2 herein below. In certain embodiments, the sequences of one or all of the predefined sets of barcode nucleic acid sequences may be sequences that allow for bioinformatic error detection and correction of at least 80%, preferably at least 85%, preferably at least 90%, and most preferably at least 95% of the possible nucleotide exchanges instead of differing in at least two nucleotide positions. Algorithms for error detection and correction are known in the art and may, for instance, be based on Hamming, SeqLev and/or Levenshtein statistics (Wesley and Weldon, 1972, Cambridge, MIT Press). An exemplary error detection method and correction method is described herein below.

A group of exemplary barcode sequences of 6 nucleotides in length that fulfill the requirements of the present invention regarding error detection and correction and/or are at least different in two nucleotide positions is: TTCCGT, TGTTGG, CGATCT, GGAGAA, CAGGAA, ACCGAA, CCACAA, AGGCAA, GACCAA, GCGTAA, CGCTAA, CGAAGA, GAGAGA, TCCAGA, AGTGGA, GTACGA, CATCGA, CTGTGA, GCAACA, TGGACA, CACACA, CTAGCA, GATGCA, ACTCCA, GTCTCA, CCGATA, GGCATA, GTGGTA, CTCCTA, ACGAAG, TGCAAG, TCAGAG, GTTGAG, TAGCAG, ATCCAG, CCTTAG, TTGAGG, AACAGG, GAATGG, AGAACG, TCTACG, TTACCG, AAGTCG, CGTATG, CAAGTG, TTCGTG, ACTGTG, GATCTG, TCGTTG, AGCTTG, GTGAAC, TACGAC, TGACAC, CTTCAC, GGTTAC, ACAAGC, TTAGGC, TAGTGC, ATCTGC, TTCACC, ATTGCC, TCATCC, CATTCC, AGGATC, GCTATC, TGTGTC, TTGCTC, AACCTC, CGGAAT, GCCAAT, CTCGAT, GGTAGT, TCTGGT, AGACGT, ACGTGT, CACTGT, ACAGCT, TAGGCT, GAACCT, ATGCCT, TGTCCT, GCTTCT, GACGTT, CAGCTT, TACTCG, GGATTC, CCATTC, GCACTT, CCTCTT, CCTGTA, AGTCAG, GACTAG, CTTAGG, CTATGG, GTTACG and GCATTG.

Preferably, when barcode segments of 6 nucleotides in length are employed the sequences of each of the sets of barcode nucleic acid sequences are selected from or consist from the 96 sequences listed above.

A group of exemplary barcode sequences of 6 nucleotides in length that fulfill the requirements of the present invention regarding error detection and correction and/or are at least different in three nucleotide positions is: TTCCGT, TGTTGG, CGATCT, GGAGAA, CAGGAA, ACCGAA, CCACAA, AGGCAA, GACCAA, GCGTAA, CGCTAA, CGAAGA, GAGAGA, TCCAGA, AGTGGA, GTACGA, CATCGA, CTGTGA, GCAACA, TGGACA, CACACA, CTAGCA, GATGCA, ACTCCA, GTCTCA, CCGATA, GGCATA, GTGGTA, CTCCTA, ACGAAG, TGCAAG, TCAGAG, GTTGAG, TAGCAG, ATCCAG, CCTTAG, TTGAGG, AACAGG, GAATGG, AGAACG, TCTACG, TTACCG, AAGTCG, CGTATG, CAAGTG, TTCGTG, ACTGTG, GATCTG, TCGTTG, AGCTTG, GTGAAC, TACGAC, TGACAC, CTTCAC, GGTTAC, ACAAGC, TTAGGC, TAGTGC, ATCTGC, TTCACC, ATTGCC, TCATCC, CATTCC, AGGATC, GCTATC, TGTGTC, TTGCTC, AACCTC, CGGAAT, GCCAAT, CTCGAT, GGTAGT, TCTGGT, AGACGT, ACGTGT, CACTGT, ACAGCT, TAGGCT, GAACCT, ATGCCT, TGTCCT, GCTTCT, GACGTT, and CAGCTT.

Preferably, when barcode segments of 6 nucleotides in length are employed, the sequences of each of the sets of barcode nucleic acid sequences are selected from or consist of the 84 sequences listed above.

In one embodiment, the numbers of barcode segments z and g may be two, $x_1$, $x_2$, $k_1$ and $k_2$ may be 96, the length of the barcode sequences B1 and the barcode sequences B2 may be 13 nucleotides, and the linker sequences L1 and L2 may have a length of one nucleotide (or may be absent). As demonstrated by the appended examples, such a barcode configuration can, when the remaining adapter sequences are designed such that they are compatible with the standard Nextera® setting, perfectly comply with standard Nextera® primers and sequencing run protocols. An exemplary design that perfectly complies with the standard Nextera® primers and sequencing run protocols is provided in the appended Examples and the sequences used therein. A corresponding method of producing solid supports with corresponding first and second transposon is also described.

In the context of the present invention in principle any sequencing adapter configurations known in the art (with the exception that it is modified to comprise the inventive barcode sequence configuration) may be employed as long as the sequencing adapters A1 and A2 are selected such that they allow library amplification. The sequencing adapter sequences A1 may comprise a common first amplification primer site and the adapter sequences A2 may comprise a common second amplification primer site, wherein the first and the second amplification primer site are different and allow for template amplification. The amplification primer may also comprise sequences that are required for flow cell attachment in standard sequencing platforms. "Common" means that all sequencing adapters A1 comprise the same amplification primer site. Similarly, "common" means that all sequencing adapters A2 comprise the same amplification primer site. Preferably, the first and second amplification primer sites are selected from a P5 primer site (SEQ ID NO: 3) and a P7 primer site (SEQ ID NO: 4). The P5 and P7 primers can be used on the surface of commercial flow cells sold by Illumina, Inc. for sequencing on various Illumina® platforms.

Further, the adapter sequences A1 may comprise a common index read primer site (index read primer site A1), said index read primer site A1 preferably being positioned directly 5' or 3' of the barcode B1. Similarly, the adapter sequences A2 may comprise a common index read primer site (index read primer site A2), said index read primer site A2 preferably being positioned directly 5' or 3' of the barcode B2. The index read primer site A1 and the index read primer site A2 have to be different in sequence. "Common" again means that this primer sites are the same in the adapter sequences A1 and A2, respectively. Preferably, the index read primer site A1 and/or the index read primer site A2 have the sequence selected from the group consisting of SEQ ID NO: 6 and SEQ ID NO: 7, which are compatible with the standard Nextera® protocol. Positioning the index read primer site directly 5' or 3' of a barcode sequence is advantageous to avoid artifacts caused by having common sequences at the same position of all index reads.

The adapter sequences A1 may further comprises a common read sequencing primer site (read sequencing primer site A1). The read sequencing primer site A1 is preferably positioned at the 5' or 3'-end of the adapter sequences A1, depending on which end of the adapter is supposed to be ligated to the target DNA fragment during tagmentation. When the adapter sequence is placed in the transfer strand, the read sequencing primer site A1 is preferably placed at the 3' end of the sequencing adapter and/or the first transposon. If a transposase recognition sequence is employed, the read sequencing primer site A1 may preferably also include the transposase recognition sequence. Similarly, the adapter sequences A2 may further comprises a common read sequencing primer site (read sequencing primer site A2). The read sequencing primer site A2 is preferably positioned at the 5' or 3'-end of the adapter sequences A2, depending on which end of the adapter is supposed to be ligated to the target DNA fragment during tagmentation. When the adapter is placed in the transfer strand, the read sequencing primer site A2 is preferably placed at the 3' end of the sequencing adapter A2 and/or the second transposon. If a transposase recognition sequence is employed, the read sequencing primer site A2 may preferably also include the transposase recognition sequence. The sequencing read primer site A1 and the sequencing read primer site A2 are different. Preferred sequencing primer sites that may be employed and that are compatible with the standard Nextera® technology are shown in SEQ ID NO: 5 and SEQ ID NO: 8. The read primer sites A1 and A2 may partially or completely overlap with other sequence features of the first and second transposons (expect for the barcode sequences which vary between the solid supports).

The transposons may be attached covalently or via a non-covalent binding (such as via an affinity moiety) to the respective solid support. Preferably, the transposons are attached via one of its strands to the respective solid support. The attachment may, however, also be mediated by both strands. The attachment is selected in a manner so that after binding of a transposase transposition activity can occur. Methods for verifying transposase activity are described in the appended Examples. In brief, tagmentation of a target DNA sample is performed and the DNA is subsequently analyzed for length, e.g. by agarose gel electrophoresis. The attachment of the transposons to the respective solid support is preferably mediated via the 5' end of the respective transfer strand and/or the 3' end of the respective non-transfer strand. Covalent attachments may be achieved by amine groups reactions to carboxylate group or succinimidyl ester. Non-covalent interaction may be mediated by a binding partner pair. In a preferred embodiment each transfer-strand of the first transposons and/or each transfer strand of the second transposons comprise an affinity moiety which mediates the attachment to the solid support. The affinity moiety is preferably comprised at the 5' end of the transfer strands and/or the 3' end of the non-transfer strands. The affinity moiety may be a first member of a binding partner pair and that binds to a second member of a binding partner pair which is immobilized on the solid support. A binding partner pair may preferably be selected from biotin-avidin and biotin-streptavidin. Other binding pairs that may be employed are known in the art and are, for example, described in WO2016/061517 A2, which is incorporated herein by reference in its entirety.

A transposon, preferably all transposons, may further comprise a solid support linker. The solid support linker is preferably a nucleic acid sequence (optionally comprising synthetic nucleotides), even more preferably a single-stranded nucleic acid sequence. Alternatively, also other linkers known in the art for linking transposons for on bead tagmentation to solid-supports may be employed. Alternative solid-support linkers are, for example, described in US 2018/0245069, and are incorporated herein by reference. The solid support linker (preferably nucleic acid sequence) is preferably positioned at the end of the strand mediating the attachment to the solid support. The solid support linker is preferably attached to the 5' end of the transfer strand and/or the 3' end of the non-transfer strand. The affinity moiety or covalent attachment site of the transposons is preferably positioned at the free end of the solid support linker (i.e. the 5' end if a solid support linker sequence is positioned at the 5' end of a transposon strand or the 3' end if a solid support linker sequence is positioned at the 3' end of a transposon strand) so that the solid support linker can attach the transposon to a solid support without getting too close to the solid support with the remaining sequence of the transposon. The advantage of having a solid support linker is that the 3' end of the transfer strand end is more accessible for transposase binding and transposition. A preferred solid support linker is a single stranded DNA sequence, preferably consisting of only one type of nucleotide, such as a poly-T, a poly-A, a poly-G or a poly-C DNA sequence. Most preferably a poly-T sequence is employed. A solid support linker sequence may comprise 10 to 50, preferably 15 to 35 nucleotides, and most preferably 25 to 35 nucleotides. Particularly preferred lengths are 34 or 35 nucleotides. The lengths of the solid support linker sequences attached to the first transposons and the second transposons may be the same or different (e.g., one may be of a length of 35 and the other may be of a length of 34 T nucleotides).

The first and second transposons are attached to a solid support. They are preferably attached to the complete outer surface or at least a portion thereof. The surface, preferably the outer surface or at least the portion thereof of the solid supports may be hydrophobic or hydrophilic with hydrophobic being preferred. As illustrated in the appended Examples, in particular Example 1, employing solid supports with a hydrophobic surface allows for a more efficient and faster on-bead tagmentation reaction. Materials from which solid supports may be made as well as coatings for generating a hydrophobic or hydrophilic surface are known in the art (see, e.g., on the world wide web at helix.mcmaster.ca/Surface_Activated_Dynabeads.pdf). The solid supports may be made from polystyrene. They may be coated with amine, carboxyl epoxy or other groups to be hydrophilic. Alternatively, they may be covered with tosyl groups to be hydrophobic.

The transfer strands of the first and second transposons may comprise a transposase recognition sequence at their 3' end and the non-transfer strands of the first and second transposons may comprise a corresponding reverse complementary transposase recognition sequence at their 5' end so as to form a double stranded transposase binding site. This feature allows for transposase binding. The transposase recognition sequence is preferably a minimum transposon sequence allowing for transposition activity upon transposase binding. Different transposon binding sites/minimal transposon sequences are known in the art (Green et al. 2012, Mol. DNA. 3 (1): 3, doi: 10.1186/1759-8753-3-3.). Since Tn5 transposases are the currently the most frequently used transposases for tagmentation, it is particularly preferred that the transposase recognition sequence/minimal transposon sequence is a Tn5 recognition sequence/minimal transposon. Particularly preferred is a transposase recognition sequence that is a ME transposase recognition sequence, preferably a ME transposase recognition sequence comprising or consisting of the sequence as defined from nucleotide position 15 to 33 in SEQ ID NO: 9 or positions 16 to 34 in SEQ ID NO: 10.

In a preferred embodiment, the non-transfer strand of one, some or preferably all of the first transposons and one, some, or preferably all of the second transposons consists of the transposase recognition sequence. This configuration allows minimizing double stranded sections in the transposons. The inventors have found that minimizing the double stranded sections minimizes undesired transposition on the solid-support attached transposon sequences upon transposase binding, thereby preventing the generation of a sequencing library that consists almost entirely of adapter sequences.

As mentioned above, each of the at least one million solid supports has multiple copies of a solid support specific, unique set of two transposons (each consisting of a first and second transposon) attached thereon. In other words, each of the at least one million solid supports has multiple copies of a solid support specific, unique set of two transposons (each consisting of a first and second transposon) immobilized thereon. The number of copies attached on each solid support and the density (i.e. the spatial distribution on the solid support) are selected in a manner to allow tagmentation in the desired fragment length (preferred fragment lengths are disclosed elsewhere herein). The number of transposons per bead can be controlled by adjusting the concentrations of the oligonucleotides during assembly or the transposons to be attached and the beads. The appended Examples illustrate different exemplary configurations and provide for methods that allow testing tagmentation activity and tagmentation fragment length. The density on the solid supports is preferably selected such that the transposons are substantially equally distributed. This is automatically achieved by performing the transposon assembly and/or attachment to the beads in solution.

The mixture of solid supports of the invention may further comprise transposase bound to the first and second transposons, preferably at least 50%, more preferably at least 60%, more preferably at least 70%, more preferably 80%, more preferably at least 90%, more preferably at least 95% and most preferably all of the first and second transposons, respectively. The binding is preferably mediated by a double stranded transposase recognition sequence formed by the 3' end of the transfer strand and the 5' end of the reverse complementary non-transfer strand of the respective transposon. Due to the dimerization of certain transposases, such as a Tn5 transposase, dimers of transposons may form on the solid supports. Such dimer is referred to as "transposome". It is particularly preferred that at least 30%, preferably at least 40% and most preferably at least 50% of the dimers/ transposomes on each solid support are heterodimers formed from a first and a second transposon. 50% would be the statistically expected value.

The mixture of solid supports provided by the present invention is preferably a mixture of solid support for on-bead tagmentation or on solid-support tagmentation. On-bead tagmentation or on solid-support tagmentation means that the transposition reaction is achieved on the solid supports or beads. To this end transposomes; i.e. complexes of transposons comprising sequencing adapters and transposase enzymes are formed on solid supports (e.g., beads). The target DNA which should be fragmented and tagged with the sequencing adapter sequences is added only subsequently. The target DNA is tagmented by the transposomes on the solid supports and the fragments resulting from the tagmentation reaction remain bound to the beads by the covalent attachment of the transfer-strand of the transposons to the target DNA fragment.

The transposase enzyme may be pre-bound to the mixture of solid supports of the present invention, to provide a ready to use bead mixture. This mixture of solid supports with preassembled transposome complexes may be stored in a buffer lacking Mg2+ ions so as to inhibit transposase activity. Activation of the tagmentation reaction may then depend on a change of the buffer conditions, e.g., by dilution of certain transposase-inhibiting buffer component by adding an aliquot of the mixture of beads to a sample volume having a different, non-inhibitory buffer composition. Alternatively, the mixture of beads of the invention may be provided without pre-bound transposase and the transposases may be provided separately. In this event, the transposase may be bound to the mixture of beads just before use. An advantage of this configuration is that the added concentration of transposase, which influences tagmentation activity, can be chosen differently depending on the tagmentation activity required.

The transposase enzyme employed in the present invention must be suitable for tagmentation. Preferably the transposase transposes the transposon sequence randomly in the target DNA, i.e. without a significant sequence bias. Preferably, a Tn5 transposase or mutant variants thereof (e.g. hyperactive mutant variants thereof) are employed. Particularly preferably a hyperactive Tn5 mutant variant having a E54K, L372P amino acid exchanges is employed (Naumann and Reznikoff, $J Biol Chem.$ 2002; 277 (20): 17623-9). The sequence of this Tn5 variant is shown in SEQ ID NO: 12. Different Tn5 transposases and methods for producing the same are known in the art.

Other exemplary transposases that may be employed include: Mu and Tn7 (Green et al. 2012, Mol. DNA. 3 (1): 3, doi: 10.1186/1759-8753-3-3.). Further transposases (and corresponding transposon recognition sequences) that may be employed are described in US 2018/0245069 A1. The transposases and the corresponding transposon recognition sequences listed therein are included by reference herein.

Tn5 transposase expression and purification is, for example, described in Picelli et al., 2014 Genome Res. 2014 December; 24:2033-2040, 10.1101/gr.177881.114). Briefly the bacterial expression plasmid pTXBX1-Tn5 (Addgene plasmid #60240) containing the hyperactive Tn5 transposase (carrying the E54K, L372P mutations) fused to an intein chitin-binding domain may be transformed into the C3013 competent cells (C3013L, New England BioLabs®, Frankfurt am Main, Germany). Expression may then be induced under addition of isopropyl β-D-1-thiogalactopyranoside (IPTG) and cells may be lysed by, e.g., using an Emulsiflex c3 (Avestin, Mannheim, Germany). The lysate may subsequently be applied to a chitin resin column (New England BioLabs®, S6651S). The Tn5 transposase domain may then be cleaved and eluted using 1,4-dithiothreitol (DTT, Sigma Aldrich®, Taufkirchen, Germany, 000000010197777001). The concentration of the eluted protein and DTT removal may then be achieved through a concentration column with a cut-off of 10 kilodalton (Amicon Ultra-15, 10 kDA, #UFC901024, Merck-Millipore, Darmstadt, Germany).

In another aspect, the present invention provides for a kit comprising the mixture of solid supports of the invention and a transposase. What has been said with respect to the mixture of solid supports and the transposase applies mutatis mutandis.

In a preferred embodiment of the kit of the invention the mixture of solid supports comprises a mixture of solid supports according to the invention that comprises in each of the first and second transposons a transposase recognition sequence at the 3' end of the transfer strand and the 5' end of the reverse complementary non-transfer strand (i.e. a double stranded transposase recognition sequence or minimal transposon). The transposase recognition sequence is selected to bind the transposase provided in the kit. Preferably the transposase recognition sequence is a ME transposase recognition sequence, preferably an ME transposase recognition sequence comprising or consisting of the sequence as defined from nucleotide position 15 to 33 in SEQ ID NO: 7 or positions 16 to 34 in SEQ ID NO: 8.

The transposase may be any of the transposases as discussed herein elsewhere or as known in the art to be suitable for tagmentation. In principle the kit may also be provided with two different transposases and the first and the second transposon may comprise different, corresponding transposase recognition sequences. Which transposase recognition sequences or minimal transposon sequences match which transposon is known in the art (see, e.g., US 2018/0245069 A1) Particularly preferred is the employment of a Tn5 transposase (as discussed also above) and a corresponding ME recognition sequence (positioned at the 3' end of the transfer strand and the 5' end of the non-transfer strand of the first and second transposons).

In yet another aspect, the present invention relates to the use of the mixture of solid supports (with transposase being bound to the transposons), or the kit of the present invention for on-bead tagmentation, preferably on-bead tagmentation of a target DNA sample.

The use may in particular involve on-solid support tagmentation of a target DNA (preferably in a single reaction vessel) while preserving the contiguity information of the target DNA molecules by adding the same solid-support specific DNA-barcode tag to fragments resulting from tagmentation of the same target DNA molecule. In other words, the present invention also relates to the use of the mixture of solid supports or the kit of the present invention for linked-read sequencing, preferably using a short-read sequencing method. Adding the same barcode tag to fragments resulting from the same target DNA molecule during tagmentation may be achieved by selecting the conditions, namely the size, shape and surface properties, the number of solid supports, the target DNA concentration and/or the number and density of first and second transposons on the beads. A key to preserving the contiguity information of the target DNA is the provision of the high number of differently barcoded solid supports in the mixture of solid supports of the invention. The number of differently barcoded solid supports in the mixture of beads is preferably at least 10%, preferably 50%, and most preferably 200% higher than the number of expected target DNA molecules in the reaction vessel to ensure efficient preservation of contiguity information. This is achieved by providing at least one million solid supports with differently barcoded transposon pairs. The appended examples provide preferred configurations and demonstrate that different configurations can achieve the desired result. Further, the appended examples also provide experimental tests for evaluation barcode collision and testing the preservation of contiguity information. As shown, for instance, a genomic DNA of a heterozygote mouse of known sequence may be tagmented and subsequently be amplified by PCR to achieve a sequencing library. The sequencing library may subsequently be analyzed by a suitable DNA sequencing approach (suitable for the employed sequencing adapter configurations). The sequencing results may then be demultiplexed with the methods described herein and used in the appended examples and plotted on the known genomic sequence. The conditions and configuration of the beads is considered to be suitable for contiguity preserving on-solid support tagmentation when at least 80%, preferably at least 90%, more preferably at least 92%, more preferably at least 94% and most preferably at least 97% of the sequence reads having identical barcode tags cluster in a contiguous genomic sequence region of a length corresponding to the average lengths of the input target DNA fragments. Preferably the length of the clusters is 20 to 500 kbp.

The number and density of the first and second transposons on the solid supports and/or the amount of bound transposase are preferably selected such that the target DNA molecules of said target DNA sample are tagmented into DNA fragments of 200 bp to 600 bp, preferably 300 bp to 500 bp, most preferably 300 bp. This is because this length range is ideally suitable for sequencing by a short-read sequencing method. A skilled person can, based on the teaching of the present invention and as illustrated in the example, define the concentrations of oligonucleotides for split-and-pool assembly of the transposons and/or the amount of transposase added to the assembled mixture of beads to achieve the desired tagmentation activity and fragment length. Tests for evaluating the length of target DNA molecules are known in the art and are described in the appended examples.

The use of the mixture of solid supports of the invention or the kit of the invention may further comprise generating a DNA library for sequencing, preferably a DNA library that preserves the contiguity information of target DNA molecules at a range of 20 to 500 kbp. The generation of a DNA library may comprise: (i) the removal of the transposase protein from the beads; (ii) a gap-filling step; and (iii) an amplification PCR with an amplification primer set matching the amplification primer sites in the common region of the sequencing adapters A1 and A2, preferably being the first and the second amplification primer sites as defined above.

Removal of the transposase can, for example, be achieved by incubating the solid supports in at least 0.3% SDS (e.g. 0.3% to 4% SDS, or exactly 0.3% SDS) and incubated at 55° C. for another 10 minutes to inactivate and strip Tn5 from DNA.

Gap-filling may be performed with methods known in the art, e.g., as described in Zhang et al (loc. cit.), WO2016/061517 A2 or the NEXTERA®-DNA-library preparation reference guide (which can be found on the world wide web at support.illumina.com/content/dam/illuminasupport/documents/documentation/chemistry_doc umentation/samplepreps_nextera/nexteradna/nextera-dna-library-prep-reference-guide-15027987-01.pdf). Preferably, the gap-filling is performed in a single step with the amplification PCR (e.g. using a Q5 polymerase such as the Q5 polymerase from NEB (NEB, M0491)) using a PCR program including a elongation step before the first denaturation step. Thus in a preferred embodiment, gap-filling may be achieved as follows: employing a PCR with amplification primers (e.g. using Q5 polymerase, preferably using the following thermocycler settings: 5 min at 72° C., 30 sec 98° C. and 12 cycles of: 98° C. for 15 sec, 65° C. for 20 sec and 72° C. for 60 sec. Optionally, a washing step may be included between gap-filling and the amplification PCR. Such washing step may, for instance, be advantageous if gap filling is not performed by the polymerase used for amplification. However, a wash step is not required when the amplification polymerase conducts the gap filling.

Preferably, the generation of a sequencing library in the use of the mixture of solid supports of the invention or the kit of the invention further comprises the step of removing transposons that have not undergone a tagmentation reaction and/or nucleic acids that are products of incorrect transposon assembly. This additional step is preferably conducted between step (i) and (ii) in the DNA library preparation. The inventors have found that this additional step prevents undesired use of the remaining transposons or misassembled oligonucleotides as primers in the amplification reactions and therefore prevents undesired barcode switch during the amplification reaction. The removal may be achieved through the combined use of a 5' to 3' exonuclease which is unable to initiate DNA digestion at nicks or gaps (e.g., lambda exonuclease; e.g. available from New England Bio-labs®, M0262S) and exonuclease I (a 3' to 5' exonuclease; e.g. available from M0293S or M0568S) in a single reaction. This is due to the specific action of lambda exonuclease in targeting phosphorylated 5' end of double-stranded DNA (dsDNA), but not gaps or nicks in dsDNA (which are present in the desired tagmented DNA before gap filling). For unphosphorylated but exposed 5' ends in free duplexes, lambda exonuclease has reduced but adequate ability to digest away the reverse strand featuring the 5' overhang. This preserves the transposition products from being degraded by lambda exonuclease. Upon completion of lambda exonuclease activity, exposed single-stranded DNA becomes a substrate for exonuclease I digestion in the 3' to 5' direction. This results in efficient clean-up of excess primers and helps minimizing barcode switching in subsequent PCR amplification due to mis-priming of barcoded—but exposed and unused—transposons between solid supports. The principle underlying the removal of remaining transposons or misassembled oligonucleotides is schematically illustrated in FIG. 18A and described in the corresponding Figure legend. Example 13 illustrates preferred but non-limiting conditions that may be employed for the removal step. Further, Example 13 provides for an exemplary analysis method that allows testing the success of the removal step.

Since the use of the solid supports of the present invention allows preserving contiguity information of target DNA molecules, the present invention also relates to uses of the mixture of solid supports or the kit of the invention for haplotyping or molecular phasing. Similarly, the mixture of solid supports or the kit of the invention may be used for analyzing microbiological consortia, e.g. for determining the composition of those based on the genomic sequences.

In a further aspect, the present invention provides for a method for generating a DNA library for sequencing from a target DNA sample involving on-solid support tagmentation with the mixture of solid supports according to the present invention. The generated DNA library preferably contains contiguity information of the DNA molecules comprised in the target DNA sample by having the same DNA barcode tag on the fragments resulting from the same target DNA molecule. The method may comprise the steps of the use as discussed, above.

The method for generating a DNA library may comprise the following steps:

a) performing on-bead tagmentation of a target DNA sample in a single reaction vessel by:

i) combining a mixture of solid supports of the invention or a subpool thereof comprising at least $10^5$ solid supports with different DNA barcode tags, wherein transposase is bound to the first and second transposons; and the target DNA sample in a single reaction vessel; and ii) incubating the mixture under conditions that allow transposase activity and tagmentation of contiguous target DNA molecules on individual solid supports so as to fragment the individual contiguous target DNA molecules on different single solid supports, wherein the tagmentation on each of the single solid supports forms fragments of the respective target DNA molecule, wherein the 5' end of the first strand of the respective target DNA molecule fragments is ligated with the 3' end of the transfer-strand of the first transposon through transposition and the 5' end of the second strand of the respective target DNA molecule fragment being the reverse complement of the first strand of the respective target DNA molecule fragment is ligated with the 3' end of the transfer-strand of the second transposon, wherein the tagmentation conditions are selected to result in target DNA molecule fragments having an average length of 300 bp to 600 bp, even more preferably 300 bp to 500 bp and most preferably 400 bp;

(b) washing the solid supports;

(c) remove the transposase proteins from the solid supports;

(d) performing a gap-filling reaction on the solid supports so as to ligate the 3' ends of the target DNA molecule fragment strands with the respective non-transferred strands; and (e) perform a PCR reaction amplifying barcode tagged target DNA molecule fragments using the solid supports as template, wherein the contiguity information of the DNA molecules comprised in the target DNA sample is maintained in that the library DNA fragments resulting from amplification of the fragments of a contiguous DNA molecule of the target DNA sample comprise a unique DNA-barcode tag provided by the barcode sequence B1 of adapter sequence A1 and the barcode sequence B2 of the adapter sequence A2 of the solid support on which tagmentation of a respective target DNA molecule occurred.

The amplification may be conducted with an amplification primer pair corresponding to the sequencing adapter sequences employed and optionally featuring sequences capable of attachment to flow cells during high-throughput sequencing. Preferably, the P5 (SEQ ID NO: 3) and P7 (SEQ ID NO: 4) primers of Illumina® and corresponding primer binding sites in the sequencing adapters may be employed.

The information regarding the selection of conditions allowing transposase activity and tagmentation of contiguous target DNA molecules on individual solid supports given above in the context of the use of the mixture of beads of the invention apply mutatis mutandis. The same applies to the test for evaluating whether the conditions fulfill this criterion. Further guidance for selecting this conditions is provided in the prior art such as WO2016/061517 A2 (see for instance, pages 19, 22, Example 2, FIG. 3 and FIG. 34 thereof).

Gap-filling may be performed with methods known in the art, e.g., as described in Zhang et al (loc. cit.), WO2016/061517 A2 or the NEXTERA®-DNA-library preparation reference guide (which can be found on the world wide web at support.illumina.com/content/dam/illuminasupport/documents/documentation/chemistry_doc umentation/samplepreps_nextera/nexteradna/nextera-dna-library-prep-reference-guide-15027987-01.pdf). Preferably, the gap-filling is performed in a single step with the amplification PCR (e.g. using a Q5 polymerase such as the Q5 polymerase from NEB (NEB, M0491)) using a PCR program including an elongation step before the first denaturation step. Thus in a preferred embodiment, gap-filling may be achieved as follows: employing a PCR with amplification primers (e.g. using Q5 polymerase, preferably using the following thermocycler settings: 5 min at 72° C., 30 sec 98° C. and 12 cycles of: 98° C. for 15 sec, 65° C. for 20 sec and 72° C. for 60 sec. Optionally, a washing step may be included between gap-filling and the amplification PCR. Such washing step may, for instance, be advantageous if gap filling is not performed by the polymerase used for amplification. However, a wash step is not required when the amplification polymerase conducts the gap filling.

Figure 18:
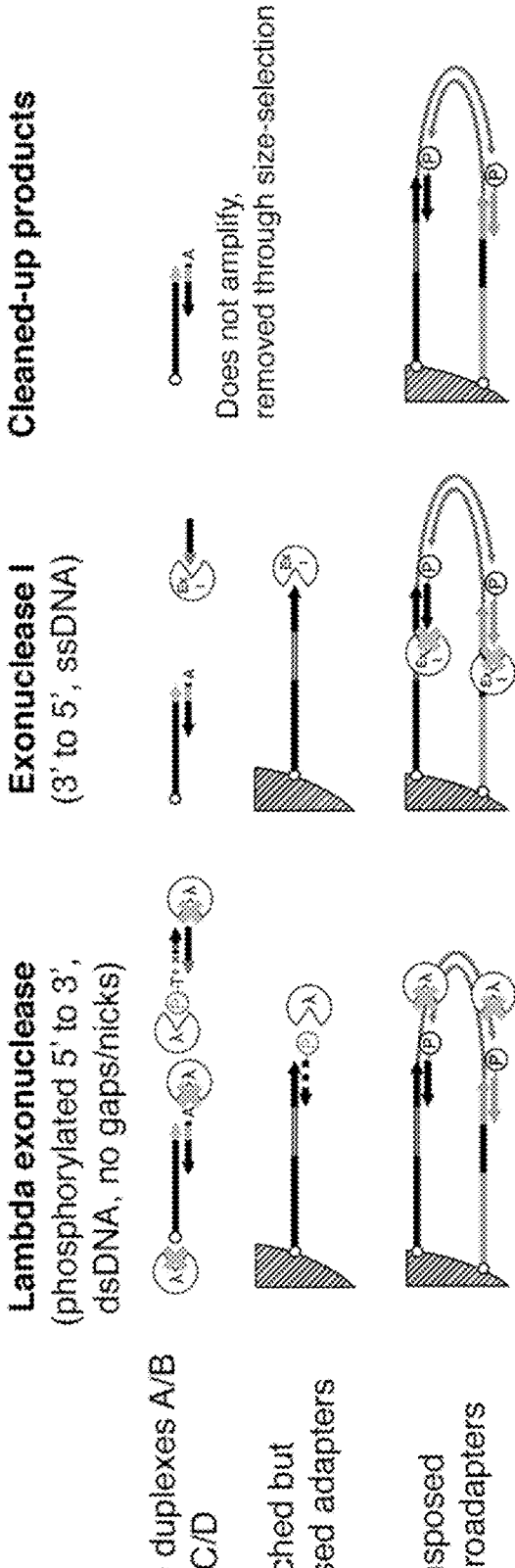
Figure 18:
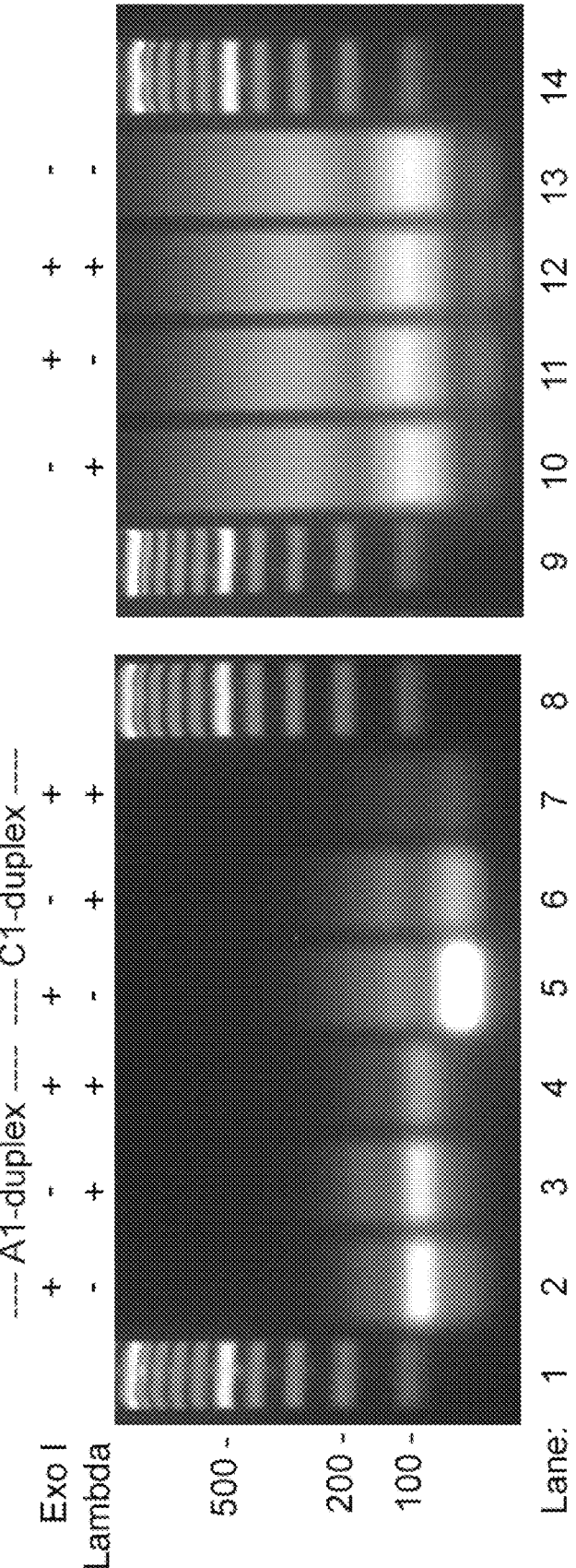

The method as defined above may further comprise (b') removing excess transposons from the solid supports that were not assembled into transposomes and/or transposomes that have not tagmented the target DNA molecule; and (b") washing the beads. Again what has been said above in the context of the use of the mixture of beads and the kit of the invention applies mutatis mutandis. FIG. 18 and the appended examples provide for a preferred embodiment for removal of excess transposons from the solid supports that were not assembled into transposomes and/or transposomes that have not tagmented the target DNA molecule.

In another aspect, the present invention relates to a DNA sequencing method, preferably a method for determining contiguous sequence information from a target DNA sample. The method preferably uses a short-read sequencing method, most preferably Illumina's TruSeq® Nextera® sequencing platform. In other words the method relates to a linked-read sequencing method. The method may comprise the following steps:

a) generating a DNA sequencing library by on-solid support tagmentation using the mixture of solid supports of the present invention;

b) performing DNA sequencing with the generated DNA sequencing library, wherein sequence information of the target DNA molecule fragments and the respective sequence of the DNA-barcode tags comprising of the respective barcode sequences B1 and B2 thereto is determined;

c) determining which target DNA molecule fragments are derived from which target DNA molecule, wherein step c) comprises:

detecting the sequences of the z barcode segments of the barcodes B1 and the g barcode segments of the barcodes B2;

performing error detection and correction individually on each of the barcode segments;

determining the DNA-barcode tags based on the error corrected barcode segment sequences and assign the DNA molecule fragments having the same barcode tag to be comprised in a contiguous target DNA molecule.

As used herein the term "error correcting barcode sequence" means that the barcode nucleic acid sequence is designed in a manner that despite a nucleotide exchange the barcode can still be assigned to one barcode sequence of a predefined set of barcode sequences. Preferably, this is achieved by using barcode sequences differing at least in two, preferably at least in three nucleotide positions per set. Error correcting barcode sequences may also be designed with methods known in the art (Peterson and Weldon, *Error-correcting Codes, 2^nd Ed.*, Cambridge, MIT Press, 1972). As regards the term "corrected barcode segment sequence", the same applies mutatis mutandis.

The method may further comprise d) assembling the sequences of the target DNA using the contiguity information derived from the DNA-barcode tag by methods known in the art (exemplary methods are provided in the appended examples). The method may further comprise deriving haplotype information from the sequences. The method may further comprise identifying SNPs, deletions insertions and/or other modifications of DNA.

Step a) of the DNA sequencing method of the invention may involve the steps of the method for generating a DNA library as described herein.

The segmented barcode structure that characterizes the mixture of solid supports of the present invention allows demultiplexing by the steps as defined in c). Performing error detection and correction on a barcode segment level is particularly advantageous as it can be done much faster and much more reliably than with a continuous barcode having a length corresponding to the length of all barcode segments together.

Step c), i.e. the demultiplexing, may be performed as a computer-implemented procedure.

Accordingly, in another aspect the present invention relates to a computer-implemented method for barcode demultiplexing comprising:

a) providing DNA sequencing data as obtainable by steps a) and b) of the sequencing method of the present invention;

b) the steps as defined in step c) of the DNA sequencing method of the present invention (as described above); i.e.:

detecting the sequences of the z barcode segments of the barcodes B1 and the g barcode segments of the barcodes B2;

performing error detection and correction individually on each of the barcode segments;

determining the DNA-barcode tags based on the error corrected barcode segment sequences and assign the DNA molecule fragments having the same barcode tag to be comprised in a contiguous target DNA molecule.

Exemplary algorithms that may be used in this method are described in the appended Examples. Especially, algorithms for demultiplexing and error detection and correction are described in appendices 1 and 2 of Example 16. Any algorithms described in the Examples are non-limiting and may be replaced by similar algorithms, e.g. based on other programming languages. As mentioned in the examples also the belfastq program of Illumina® or 10× Genomics software may be employed.

In another aspect, the present invention relates to a computer program product comprising instructions which, when the program is executed by a computer, cause the computer to carry out the steps as defined in step c) of the DNA sequencing method of the invention (as described above) on DNA sequencing data as obtainable by steps a) and b) of the DNA sequencing method of the invention (as described above). In other words, the present invention also provides for a computer program product comprising instructions which, when the program is executed by a computer cause the computer to conduct the steps of the computer-implemented method of the present invention (as described above). Similarly, a computer-readable medium comprising instructions which, when executed by a computer, cause the computer to carry out the steps as defined in step c) of the DNA sequencing method of the invention (as described above) on sequencing data as obtainable or obtained by steps a) and b) of the DNA sequencing method of the invention.

Exemplary algorithms comprising the instructions mentioned above are provided in the appended Examples (see also further explanations with respect to the computer-implemented method of the invention, above)

According to another aspect of the invention a method for producing a mixture of solid supports of the invention is provided. The method of producing the mixture of solid support according to the invention comprises assembling the multiple identical copies of the solid-support specific set of two transposons on the at least 1 million solid supports by a stepwise split-and-pool ligation assembly of a set of DNA molecules. The set of DNA molecules for the split-and-pool ligation assembly consists of first set of double stranded DNA molecules for assembling the first transposons and a second set of double stranded DNA molecules for assembling the second transposons. The first set of DNA molecules consists of z subsets of DNA molecules, preferably wherein z is 2, 3 or 4. A first subset "A" of the z subsets of the first set of DNA molecules consists of DNA molecules that each comprise (i) a common solid-support attachment site on the first end; and (ii) one of the $x_1$ nucleic acid sequences of the predefined set for the first barcode segment of the z barcode segments of the barcode sequences B1 with a single stranded overhang of one or two nucleotides on the opposite second end. A second subset "C" of the z subsets of the first set of DNA molecules consists of DNA molecules that each comprise: (i) one of the $x_z$ nucleic acid sequences of the predefined set of barcode nucleic acids sequences of the last barcode segment of the barcode sequences B1 and a single stranded overhang of one or two nucleotides that is reverse complementary to the overhang of the DNA molecules of the subset A or the second to the last barcode segment of the barcode sequence B1 on the first end; and (ii) a transposase recognition site on the opposite second end. If z≥3, the other subsets of the z subsets of DNA molecules consist of the $x_z$ to $x_{z-1}$ nucleic sequences of the predefined sets of barcode nucleic acid sequences for the second to z−1 barcode segment of the barcodes B1 having on both ends single stranded overhangs being reverse complementary with the overhangs of the adjacent barcode segments, respectively. The second set of DNA molecules for assembling the second transposons consists of g subsets of DNA molecules, preferably wherein g is 2, 3 or 4. A first subset "B" of the g subsets of the second set of DNA molecules consists of DNA molecules that each comprise: (i) a common solid-support attachment site on the first end; and (ii) one of the $k_1$ nucleic acid sequences of the predefined set of barcode nucleic acid sequences for the first barcode segment of the g barcode segments of the barcode sequences B2 and a single stranded overhang of one or two nucleotides on the opposite second end. A second subset "D" of the g subsets of the second set of DNA molecules consists of DNA molecules that each comprise (i) one of the $k_g$ nucleic acid sequences of the predefined barcode nucleic acid sequences for the last barcode segment of the barcodes sequences B2 and a single stranded overhang of one or two nucleotides that is reverse complementary to the overhang of the DNA molecules of the subset B or the second to the last barcode segment of the barcode sequences B2 on one end; and (ii) a transposase recognition site on the opposite second end. If g≥3, the other subsets of the g subsets of DNA molecules consist of the $k_2$ to $k_{g-1}$ nucleic acid sequences of the second to $k_{g-1}$ barcode segment of the barcode sequence B2 having on both ends single stranded overhangs being reverse complementary with the overhangs of the adjacent barcode segments, respectively.

What has been said above for the mixture of solid supports of the invention applies mutatis mutandis to the method of production of the same. In particular, also the fact that the nucleic acid sequences in each of the predefined barcode nucleic acid sequence sets pairwise differ by at least two, preferably three nucleotides applies mutatis mutandis. To achieve one million different solid supports, the value of the numbers $k_1$ to $k_g$, and $x_1$ to $x_z$ must be selected accordingly (see mathematical definition in the description of the mixture of solid supports of the invention).

As mentioned above the overhangs for ligation of the double stranded DNA molecules is preferably selected in a length of one or two nucleotides. In principle also longer overhangs may be employed. However, using shorter overhangs has the advantage of keeping the overall length of the barcode sequences as short as possible, in order to position it in an indexing position compatible with other DNA sequencing libraries.

Above, the crucial components of the double stranded DNA molecules for split-and-pool assembly are defined. The remaining parts of the DNA molecules may be selected depending on the adapter sequences and primer binding sites required. Respective sequences, e.g., to assemble transposons with sequencing adapters A1 and A2, respectively, that are compatible with standard sequencing approaches are known in the art.

The one or two nucleotide overhangs employed in the context of the present invention can in principle be catalyzed by different ligases, such as Quick ligase or a TA ligase (such as Blunt/TA ligase). The present inventors found that it is particularly preferable to employ at least in one of the ligation steps a TA-ligase, preferably a Blunt/TA ligase (e.g., available from NEB as Blunt/TA ligase Mix, M0367). Especially when using complementary nucleotide overhangs of one nucleotide in length and being A on one overhang and T on the other overhang, the inventors found that by using TA-ligase surprisingly nearly full ligation efficiency was achieved. This finding was rather unexpected since previous split-and-pool ligation methods such as described in Zhang et al. (loc. cit.) and Wang et al. (loc. cit.) used splint ligation and much longer overhangs, respectively.

In a preferred embodiment of the production method of the invention, the ligation of double stranded DNA molecules comprising the barcode segments is conducted via single basepair overhangs and the ligation reactions are mediated by the enzyme Blunt/TA ligase. Such a ligase is commercially available (e.g., available from NEB as Blunt/TA ligase Mix, M0367) and the reaction may be conducted as described in the appended examples or according to the manufacturer's protocol.

When employing microtiter plates and performing several ligation reactions in parallel the reaction may be as follows: i) provide the solid support with a part of the transposon(s) pre-attached, ii) add the next DNA molecule to be attached, iii) add Blunt/TA Ligase Master Mix to the reaction to the manufacturers' indicated concentration, (iv) Seal the plate and vortex to re-suspend the solid supports in the liquid, and (v) incubate while mixing on a plate-rotator at 9 r.p.m. at room temperature for about 15 minutes.

In a preferred embodiment of the production method of the invention the attachment of the first and second transposons to the solid supports is mediated by one strand of the transposons, respectively. The method in this preferred embodiment may further comprise:

(i) removing the other strand (non-attached strand) of the transposons wherein said removing comprises melting in the presence of a sodium hydroxide solution, wherein the sodium hydroxide concentration is between 0.1 M and 0.15 M, preferably 0.15 M (ii) washing the solid supports of step (i); and (iii) hybridizing a 5' phosphorylated single-stranded oligonucleotide consisting of the reverse complementary sequence of the transposase recognition sequence to the single stranded sequences so as to generate transposons having a transfer and non-transfer strand.

The single-stranded oligonucleotide used in step (iii) may consist of the nucleic acid sequence being reverse complementary to the transposase recognition sequence in the solid-support attached strands. This has the advantage that transposons with a minimum of double stranded DNA sequences can be produced. As discussed above, this prevents self-tagmentation upon binding of a transposase.

Exemplary DNA molecules forming a subset A with an A overhang in the linker L1 sequence may be double-stranded DNA molecules assembled from single stranded oligonucleotides with SEQ ID NOs: 73 to 168 and the corresponding reverse complementary SEQ ID NOs: 457 to 552, respectively.

Exemplary DNA molecules forming a subset B with a G overhang in the linker L2 sequence may be double-stranded DNA molecules assembled from single stranded oligonucleotides with SEQ ID NOs: 169 to 264 and the corresponding reverse complementary SEQ ID NOs: 937 to 1032, respectively.

Exemplary DNA molecules forming a subset C with a T overhang in the linker L1 sequence may be double-stranded DNA molecules assembled from single stranded oligonucleotides with SEQ ID NOs: 1225 to 1320 and the corresponding reverse complementary SEQ ID NOs: 265 to 360, respectively.

Exemplary DNA molecules forming a subset D with a C overhang in the linker L2 sequence may be double-stranded DNA molecules assembled from single stranded oligonucleotides with SEQ ID NOs: 1897 to 1992 and the corresponding reverse complementary SEQ ID NOs: 361 to 456, respectively.

Exemplary DNA molecules forming a subset A with a C overhang in the linker L1 sequence maybe double-stranded DNA molecules assembled from single stranded oligonucleotides with SEQ ID NOs: 73 to 168 and the corresponding reverse complementary SEQ ID NOs: 553 to 648, respectively.

Exemplary DNA molecules forming a subset A with a T overhang in the linker L1 sequence maybe double-stranded DNA molecules assembled from single stranded oligonucleotides with SEQ ID NOs: 73 to 168 and the corresponding reverse complementary SEQ ID NOs: 649 to 744, respectively.

Exemplary DNA molecules forming a subset A with a G overhang in the linker L1 sequence maybe double-stranded DNA molecules assembled from single stranded oligonucleotides with SEQ ID NOs: 73 to 168 and the corresponding reverse complementary SEQ ID NOs: 745 to 840, respectively.

Exemplary DNA molecules forming a subset B with a T overhang in the linker L2 sequence maybe double-stranded DNA molecules assembled from single stranded oligonucleotides with SEQ ID NOs: 169 to 264 and the corresponding reverse complementary SEQ ID NOs: 841 to 936, respectively.

Exemplary DNA molecules forming a subset B with an A overhang in the linker L2 sequence maybe double-stranded DNA molecules assembled from single stranded oligonucleotides with SEQ ID NOs: 169 to 264 and the corresponding reverse complementary SEQ ID NOs: 1033 to 1128, respectively.

Exemplary DNA molecules forming a subset B with a C overhang in the linker L2 sequence maybe double-stranded DNA molecules assembled from single stranded oligonucleotides with SEQ ID NOs: 169 to 264 and the corresponding reverse complementary SEQ ID NOs: 1129 to 1224.

Exemplary DNA molecules forming a subset C with a G overhang in the linker L1 sequence may be double-stranded DNA molecules assembled from single stranded oligonucleotides with SEQ ID NOs: 1321 to 1416 and the corresponding reverse complementary SEQ ID NOs: 265 to 360, respectively.

Exemplary DNA molecules forming a subset C with an A overhang in the linker L1 sequence may be double-stranded DNA molecules assembled from single stranded oligonucleotides with SEQ ID NOs: 1417 to 1512 and the corresponding reverse complementary SEQ ID NOs: 265 to 360, respectively.

Exemplary DNA molecules forming a subset C with an C overhang in the linker L1 sequence may be double-stranded DNA molecules assembled from single stranded oligonucleotides with SEQ ID NOs: 1513 to 1608 and the corresponding reverse complementary SEQ ID NOs: 265 to 360, respectively.

Exemplary DNA molecules forming a subset D with a G overhang in the linker L2 sequence may be double-stranded DNA molecules assembled from single stranded oligonucleotides with SEQ ID NOs: 1705 to 1800 and the corresponding reverse complementary SEQ ID NOs: 361 to 456, respectively.

Exemplary DNA molecules forming a subset D with an A overhang in the linker L2 sequence may be double-stranded DNA molecules assembled from single stranded oligonucleotides with SEQ ID NOs: 1801 to 1896 and the corresponding reverse complementary SEQ ID NOs: 361 to 456, respectively.

Exemplary DNA molecules forming a subset D with a T overhang in the linker L2 sequence may be double-stranded DNA molecules assembled from single stranded oligonucleotides with SEQ ID NOs: 1609 to 1704 and the corresponding reverse complementary SEQ ID NOs: 361 to 456, respectively.

As mention in context with the mixture of solid supports of the invention, z may be 2 and g may be 2. In this embodiment, the DNA molecules of subset A and the DNA molecules of subset C are preferably ligated during the split-and-pool ligation using a first reverse complementary single nucleotide overhang pair and the DNA molecules of subset B and the DNA molecules of subset D are ligated preferably by using a second reverse complementary single nucleotide overhang pair.

The assembly order of the split-and-pool ligation may be (i) DNA molecules of subset A, (ii) DNA molecules of subset B, (iii) DNA molecules of subset C and (iv) DNA molecules of subset D, wherein the first and the second reverse complementary single nucleotide overhang pairs comprise different nucleotides. Optionally the assembly steps (i) and (ii) may be replaced by providing solid supports having the respective pairs of DNA molecules A and B pre-attached. Pre-attachment may be mediated also be affinity binding partner interaction or by covalent linkage to the solid supports.

Alternatively, the assembly order of the split-and-pool ligation may be (i) DNA molecules of subset A, (ii) DNA molecules of subset C, (iii) DNA molecules of subset B and (iv) DNA molecules of subset D. In this context, again, the first and the second reverse complementary single nucleotide overhang pairs may be the same or different. Optionally the assembly step (i) is replaced by providing solid supports having the respective pairs of DNA molecules A and B pre-attached. Pre-attachment may be mediated also be affinity binding partner interaction or by covalent linkage to the solid supports.

The principle of "split-and-pool ligation" assembly of barcoded transposons on solid supports is known in the art and is, e.g. described by Wang et al. (loc. cit.) and Zhang et al. (loc. cit.). However, these studies do not teach using at least two barcode segments with at least two, preferably three nucleotide sequences being pairwise different on a barcode segment level. Exemplary examples for the split-and-pool assembly in different combinatorial complexities are provided in the appended examples. The basic principle is also schematically illustrated for the assembly of an exemplary mixture of solid supports comprising two barcode segments per first and second transposon. In the split-and-pool assembly essentially each of the transposons is assembled step by step by ligation of two or more double stranded oligonucleotides (also referred to as duplexes herein) per transposon and the combinatory assembly is achieved by splitting the solid supports to wells, attach/ ligate in each well a different oligonucleotide (with a different barcode segment) to the solid support/already attached oligonucleotide with reverse complementary overhang, and subsequently repeat the split-and-pool procedure with the next oligonucleotide to be attached. The oligonucleotides have overhangs being reverse complementary to the overhang of the previous and/or next oligonucleotide to be assembled. The first oligonucleotide of each transposon may either be pre-attached (e.g., by being coupled to a binding partner of an affinity binding pair as described elsewhere herein or by covalent attachment) or may be bound to a mixture of solid supports as a first step. The first oligonucleotide may already comprise the first barcode segment. If there are more than two barcode segments the oligonucleotides with the exception of the first oligonucleotide and the last oligonucleotide preferably consist only of the barcode segment with a first overhang matching the overhang of the previous oligonucleotide and a second overhang on the opposite end matching the overhang of the next oligonucleotide. The first oligonucleotide may comprise the common adapter sequence A1 and A2, respectively, as well as a solid support linker sequence (e.g. as specified further above). The last oligonucleotide of the transposons comprises a sequence for transposase binding. This may be a single stranded nucleic acid sequence for a hybridization linkage or preferably a transposon recognition sequence (e.g., an ME sequence).

In yet another aspect, the present invention provides for a method of producing a mixture of beads for on solid-support tagmentation. The method corresponds to the method of producing the mixture of beads of the invention. To get the solid supports ready for solid-support based tagmentation the method further comprises binding transposase to the transposons, preferably the transposase recognition sequences of the transposons. As discussed in the context of the mixture of solid supports of the invention, tests for assessing whether the number and density of first and second transposons assembled on the solid-supports is useful for on bead tagmentation (in particular also reaching the desired fragment sizes). Based on this tests a skilled person can identify the concentration of oligos needed for the assembly and the amount of transposase to be added.

The principle of assembling barcoded oligonucleotides on beads employed by the method of producing the mixture of solid supports of the present invention can generally be extended to production of barcoded oligonucleotides on solid supports, such as beads or microbeads. Such beads may also be useful for non-sequencing related purposes. In addition, other sequencing approaches involving in solution tagmentation and only subsequently binding the target DNA on solid supports have been described by Zhang et al. (loc. cit.) and Wang et al. (loc. cit.). For use in these methods the production of short but diverse barcodes on beads would also be advantageous in order to limit the sequencing cycles required for determining the barcode sequence and/or to maximize the "in line" sequencing coverage of the target DNA fragment.

Accordingly, in another aspect, the invention relates to a method for split-and-pool ligation assembly segmented barcodes on solid supports so as to achieve a pool of differently barcoded solid supports, wherein the adjacent barcode segments are ligated via reverse complementary pairs of base pair overhangs of a length of one or two nucleotides, wherein the ligation of the one base pair overhangs. The ligation of the overhangs is preferably catalyzed by a TA ligase, most preferably by Blunt/TA ligase.

What has been said for the method of producing the solid supports of the present invention applies mutatis mutandis with the exception that the oligonucleotides in this aspect are not restricted to comprise any of the sequence features except for the barcode segments and the solid support attachment site.

The present invention also provides for a method of producing a mixture of beads of the present invention in which the barcode segments in the barcode sequences are directly linked to each other, i.e. without linker sequences L1 and L2 (also referred to as "linker-less" or "linker-free" herein). The method is based on a similar split-and-pool ligation assembly as the method for producing a mixture of beads with overhangs of one or two nucleotides in length. The major difference is the configuration of the DNA molecules that are stepwise assembled. An exemplary embodiment of this method is presented in Example 14. Each of the first and the second transposons may be assembled as described for one transposon in Example 14 (or Example 15) and as schematically illustrated in FIGS. 22 and 23, respectively. For each transposon, first a single stranded oligonucleotide without a barcode segment or with one of the first barcode segments is attached to the beads via one end (i.e. 5' or 3' end). If present, the barcode segment is positioned on the opposite end than the attachment site. Optionally pre-assembled beads having the first oligonucleotides already attached may be provided.

The subsequent DNA molecules to be attached comprise an overhang being complementary to the non-bead attached end, i.e. are "branched" polynucleotides. To have a sequence complementary with also the multiple different barcode sequences deoxyinosine nucleotides/bases and/or other universal nucleotides/bases (e.g. 5-nitroindole nucleotides/ bases) that can pair with all four canonical bases are employed at the respective positions. Such universal nucleotides/bases (e.g., deoxyinosine nucleotides/bases or 5-nitroindole nucleotides/bases) can form base pairs with any of the canonical nucleobases, i.e. any barcode sequence. The single stranded overhang should also comprise a section of at least 5, preferably 10 nucleotides being reverse complementary to the sequence preceding the first barcode segment. The "branched" polynucleotides for adding the subsequent barcode segments further comprise a double stranded extension on the end of the barcode segment sequence opposite of the end with the single stranded overhang. An exemplary branched polynucleotide may be double-stranded DNA molecules assembled from single stranded oligonucleotides with SEQ ID NOs: 1994 and 1995. Other exemplary branched polynucleotides for generating barcode diversity may have the sequences with the exception of the barcode sequence, i.e. the sequence of the barcode segments comprised therein (i.e. positions 11 to 16 of SEQ ID NO: 1994 and positions 15 to 20 of SEQ ID NO: 1995). Preferably, such other polynucleotides may comprise any of the barcode sequences as mentioned herein and as used in the double stranded DNA molecules used in the overhang based split-and-pool-assembly strategy (see positions 55 to 60 of SEQ ID NOs: 73 to 168). The double stranded extension is also referred to as "stem" (see also FIGS. 22 and 23). This extension comprises a type IIS restriction enzyme site, preferably a SapI or MlyI site, in a position such that the digestion with the corresponding type IIS restriction enzyme cuts the strand without the single stranded extension right after the barcode segment sequence and creates a phosphorylated 5' end (depending on the end of the first oligonucleotide being attached on the solid support).

The assembly is achieved by first ligating the part of the transposon that is already attached to the solid support with the subsequent branched polynucleotide (e.g. using Blunt/TA ligase or another ligase), performing a restriction digest with the corresponding type IIS restriction enzyme to create a 5' phosphorylated end on the bead attached strand, and perform an exonuclease treatment (here either 5' to 3' exonuclease has to be used if the 5' end of the first oligonucleotide is attached to the solid support or a 3' to 5' exonuclease has to be used if the 3' end of the first oligonucleotide is attached to the solid support). An exemplary branched polynucleotide extension envisioned above may be double-stranded DNA molecules assembled from single stranded oligonucleotides with SEQ ID NOs: 1996 and 1997. Other exemplary branched polynucleotides for generating barcode diversity may have the sequences with the exception of the barcode sequence, i.e. the sequence of the barcode segments comprised therein (i.e. positions 11 to 16 of SEQ ID NO: 1996 and positions 15 to 20 of SEQ ID NO: 1997). Preferably, such other polynucleotides may comprise any of the barcode sequences as mentioned herein and as used in the double stranded DNA molecules used in the overhang based split-and-pool-assembly strategy (see positions 55 to 60 of SEQ ID NOs: 169 to 264).

The last "branched" polynucleotide to be assembled may differ from the previous "branched polynucleotides in that the "stem" does not comprise the restriction enzyme site. Instead, the sequence of the "stem" may correspond to a transposase recognition sequence (as described herein elsewhere). This is to create a transposon with a terminal transposase recognition sequence, which can have the sequence of Tn5ME-A, Tn5ME-B or the reverse complement of Tn5MErev (SEQ ID NOs: 9 to 11). An exemplary branched polynucleotide may be double-stranded DNA molecules assembled from single stranded oligonucleotides with SEQ ID NOs: 1998 and 1999. Other exemplary branched polynucleotides for generating barcode diversity may have the sequences with the exception of the barcode sequence, i.e. the sequence of the barcode segments comprised therein (i.e. positions 10 to 15 of SEQ ID NO: 1998 and positions 38 to 43 of SEQ ID NO: 1999). Preferably, such other polynucleotides may comprise any of the barcode sequences as mentioned herein and as used in the double stranded DNA molecules used in the overhang based split-and-pool-assembly strategy (see positions 2 to 7 of SEQ ID NOs: 1225 to 1608).

In yet another aspect the present invention relates to solid-supports for contiguity preserving on solid-support tagmentation, wherein the one or more barcode sequences comprised in the adapter sequences of the solid support-attached transposons are each segmental barcode sequences comprising at least 2 (preferably up to 4) barcode segments (preferably of 4 to 9 nucleotides in length) which are directly linked to each other or are linked via a linker sequence of one or two nucleotides in length.

The present invention also relates to the following items:
1. A mixture of solid supports comprising at least one million solid supports, wherein each of said at least one million solid supports comprises multiple identical copies of a solid support-specific set of two transposons, wherein each solid support-specific set of two transposons comprises a DNA-barcode tag that distinguishes the solid support from all other solid supports of the at least one million solid supports, wherein the first transposon of each set of two transposons comprises an adapter sequence A1 for sequencing library generation within one of its strands and the second transposon of each set of two transposons comprises an adapter sequence A2 for sequencing library generation within one of its strands, wherein the one strand of the first transposon comprising adapter sequence A1 and the one strand of the second transposon comprising the adapter sequence A2 are both the transfer or the non-transfer strand of the respective transposon, wherein the first transposon and the second transposon of each set of two transposons are configured such that a transposase can bind to the transposon end at which the 3'end of the transfer strand is positioned, wherein the non-transfer strand of the first transposon and the non-transfer strand of the second transposon of each set of two transposons are 5' phosphorylated, wherein the unique DNA barcode tag of each solid support of the at least one million solid supports consists of a first barcode sequence B1 comprised in the adapter sequence A1 and a second barcode sequence B2 comprised in the adapter sequence A2, wherein there are in total m different barcode sequences B1 resulting in m different sequencing adapters A1 that differ only in the barcode sequence B1 but are otherwise identical, wherein m is an positive integer, wherein there are in total n different barcode sequences B2 resulting in n different sequencing adapters A2 that differ only in the barcode but are otherwise identical, wherein n is an positive integer, wherein the m different barcode sequences B1 are of the same length being selected from 8 to 25 nucleotides, preferably 9 to 18 nucleotides, and most preferably 9 to 13 nucleotides, and have a segmented barcode structure comprising z barcode segments, wherein the segmented barcode structure of the m different barcode sequences is the same regarding the number z, the positioning and the lengths of the z barcode segments, wherein z is 2, 3 or 4, wherein each of the z barcode segments has a length of 4 to 9 nucleotides, wherein the n different barcode sequences B2 are of the same length being selected from 8 to 25 nucleotides, preferably 9 to 18 nucleotides, and most preferably 9 to 13 nucleotides, and have a segmented barcode structure comprising g barcode segments, wherein the segmented barcode structure of the g different barcode sequences is the same regarding the number g, the positioning and the lengths of the g barcode segments, wherein g is 2, 3 or 4, wherein each of the g barcode segments has a length of between 4 and 9 nucleotides, wherein the nucleic acid sequence of each of the z barcode segments of the barcode sequences B1 is selected from a set of predefined barcode nucleic acid sequences that is assigned to the respective barcode segment, wherein each of the assigned sets of the in total z predefined sets of barcode nucleic acids comprises a positive integer of different barcode nucleic acid sequences, wherein the positive integers of different barcode nucleic acid sequences assigned to the respective barcode segments of the barcodes B1 are defined as $x_1$ to $x_z$, wherein $x_1$ is the number of different barcode nucleic acid sequences of the set assigned to the barcode segment positioned closest to the first end of the barcode sequence B1 and $x_z$ is the number of different barcode nucleic acid sequences of the set assigned to the barcode segment positioned closest to the second end of the barcode sequence B1, wherein the nucleic acid sequence of each of the g barcode segments of the barcode sequence B2 is selected from a set of predefined barcode nucleic acid sequences that are assigned to the respective barcode segment, wherein each of the assigned sets of the in total g predefined sets of barcode nucleic acids comprises a positive integer of different barcode nucleic acid sequences, wherein the positive integers of different barcode nucleic acid sequences assigned to the respective barcode segments of the barcodes B2 are defined as $k_1$ to $k_y$, wherein $k_1$ is the number of different barcode nucleic acid sequences of the set assigned to the barcode segment positioned closest to the first end of barcode sequence B2 and $k_z$ is the number of different barcode nucleic acid sequences of the set assigned to the barcode segment positioned closest to the second end of the barcode sequence B2, wherein $$\prod_{i=1}^{z} x_i = m$$

and $$\prod_{i=1}^{g} k_i = n$$

wherein each predefined set of nucleic acid sequences consists of at least two nucleic acid sequences that pairwise differ from each other in at least two nucleotide positions, and preferably three or more positions, and wherein $m \times n \geq 1 \times 10^6$.

2. The mixture of solid supports of item 1, wherein the adjacent barcode segments of the z barcode segments of the barcode sequence B1 are connected directly or by a linker sequence(s) L1, and wherein the adjacent barcode segments of the g barcode segments of the barcode sequence B2 are connected directly or by a linker sequence(s) L2, wherein the linker sequences L1 and L2 are of a length of one or two nucleotides.

3. The mixture of solid supports of items 1 or 2, wherein the adjacent barcode segments of the z barcode segments of the barcode sequence B1 are connected directly, and wherein the adjacent barcode segments of the g barcode segments of the barcode sequence B2 are connected directly.

4. The mixture of solid supports of any one of items 1 to 3, wherein each of the barcode sequences B1 and each of the barcode sequences B2 has a length of 9 to 18, preferably 9 to 13 nucleotides.

5. The mixture of solid supports of any one of items 1 to 4, wherein the adapter sequence A1 is configured to comprise the barcode sequence B1 in a first indexing position otherwise used for sample multiplexing, and wherein the adapter sequence A2 is configured to comprise the barcode sequence B2 in a second indexing position otherwise used for sample multiplexing, wherein the first and the second indexing position are different.

6. The mixture of solid supports of item 5, wherein the first and the second indexing position are selected from an i5 and i7 indexing position.

7. The mixture of solid supports of item 4 or 6, wherein the barcode sequences B1 and the barcode sequences B2 have a length of 9 to 13 nucleotides, preferably 13 nucleotides.

8. The mixture of solid supports of any one of items 1 to 7, wherein both z and g are 2.

9. The mixture of solid supports of item 8, wherein both z and g are 2, wherein $x_1$, $x_2$, $k_1$ and $k_2$ are 84 to 96, wherein the length of the barcode sequences B1 and the barcode sequences B2 is 13 nucleotides, and wherein the linker sequences L1 and L2 have a length of one nucleotide.

10. The mixture of solid supports of any one of items 1 to 9, wherein the adapter sequences A1 comprise a common first amplification primer site and the adapter sequences A2 comprise a common second amplification primer site, wherein the first and the second amplification primer site are different and are selected from the group consisting of a P5 primer site and a P7 primer site.

11. The mixture of solid supports of any one of items 1 to 10, wherein the adapter sequences A1 comprise a common index read primer site (index read primer site A1), said index read primer site A1 being positioned directly 5' or 3' of the barcode B1, and wherein the adapter sequences A2 comprise a common index read primer site (index read primer site A2), said index read primer site A2 being positioned directly 5' or 3' of the barcode B2, and wherein the index read primer site A1 and the index read primer site A2 are different.

12. The mixture of solid supports of item 11, wherein the index read primer site A1 and/or the index read primer site A2 comprise or consist of a sequence selected from the group consisting of SEQ ID NO: 6 and SEQ ID NO: 7.

13. The mixture of solid supports of any one of items 1 to 12, wherein the adapter sequences A1 comprises a common read sequencing primer site (read sequencing primer site A1), preferably at the 3'-end of the adapter sequences A1, and/or wherein the adapter sequences A2 comprises a common read sequencing primer site (read sequencing primer site A2), preferably at the 3'-end of the adapter sequences A2, wherein the sequencing read primer site A1 and the sequencing read primer site A2 are different.

14. The mixture of solid supports of any one of items 1 to 13, wherein each transfer-strand of the first transposons and/or the transfer strand of the second transposons comprises an affinity moiety which mediates the attachment to the solid support, preferably wherein the affinity moiety is comprised at the 5' end of the respective transfer strand.

15. The mixture of solid supports of item 14, wherein the affinity moiety is a first member of a binding partner pair, and wherein the solid support (preferably the surface or a portion thereof) comprises the second member of said binding partner pair.

16. The mixture of solid supports of item 15, wherein the binding partner pair is biotin-avidin, preferably biotin-streptavidin.

17. The mixture of solid supports of any one of items 1 to 16, wherein a solid support linker sequence, preferably a poly-T DNA sequence comprising 10 to 35 T nucleotides is positioned between the attachment site of the first and second transposons to the surfaces of the respective solid supports.

18. The mixture of solid supports of item 17, wherein the solid support linker sequence forms the 5' end of the transfer strands of the first and the second transposons.

19. The mixture of solid supports of any one of items 1 to 18, wherein the solid supports (preferably the surfaces of the solid supports) are hydrophobic.

20. The mixture of solid supports of any one of items 1 to 19, wherein the solid supports are beads, preferably beads of a diameter of between 1 μm and 100 μm, preferably of between 1 μm to 5 μm.

21. The mixture of solid supports of any one of items 1 to 20, wherein the transfer strands of the first and second transposons comprise a transposase recognition sequence at their 3' end, preferably an ME transposase recognition sequence having the sequence as defined from nucleotide position 15 to 33 in SEQ ID NO: 9 or positions 16 to 34 in SEQ ID NO: 10, and wherein the non-transfer strands of the first and second transposons comprise a reverse complementary transposase recognition sequence at their 5' end.

22. The mixture of solid supports of any one of items 1 to 21, wherein one strand of each first and each second transposon consists only of a transposase recognition sequence.

23. The mixture of solid supports of any one of items 1 to 22, wherein on the surface of each solid support of said at least one million solid supports:

transposase, preferably Tn5 transposase is bound to the first and second transposons; and a plurality of heterodimeric transposome complexes each comprising a first transposome comprising the first transposon and a second transposome comprising the second transposon exist.

24. The mixture of solid supports of item 23, wherein the mixture of solid supports is a mixture of solid supports for on-bead-tagmentation.

25. A kit, preferably for on bead tagmentation, comprising:

a) the mixture of solid supports of any one of items 1 to 22; and b) transposase.

26 Use of the mixture of solid supports of item 23 or 24, or the kit of item 25 for on-solid support tagmentation of a target DNA sample.

27. The use of item 26, wherein the number and density of the first and second transposomes on the solid supports of said mixture of solid supports is selected such that tagmentation of the target DNA molecules of said target DNA sample into DNA fragments of 200 bp to 600 bp, preferably 300 bp to 500 bp occurs.

28. The use of item 26 or 27, wherein the on-solid support tagmentation is performed under conditions that allow tagmentation of contiguous DNA molecules of said target DNA sample on a single solid support so as to add the same DNA barcode tag onto the target DNA fragments arising from a contiguous DNA molecule.

29. The use of any one of items 26 to 28, wherein said use further comprises generating a DNA library for sequencing, preferably a DNA library that preserves the contiguity information of target DNA molecules at a range of 20 to 500 kbp.

30 The use of item 29, wherein said generating of a DNA library comprises:

(i) the removal of the transposase protein from the beads (ii) a gap-filling step; and (iii) an amplification PCR with a amplification primer set matching the first and second amplification primer sites.

31. The use of item 30, wherein said generating a sequencing library further comprises removing transposons that have not undergone a tagmentation reaction and/or nucleic acids that are products of incorrect transposon assembly, preferably between step (i) and (ii).

32. A method for generating a DNA library for sequencing from a target DNA sample, said DNA library containing contiguity information of the DNA molecules comprised in the target DNA sample, wherein said method comprises:

a) performing on-bead tagmentation of the target DNA sample in a single reaction vessel by combining a mixture of solid supports of item 23 or 24 or a subpool thereof comprising at least $10^5$ solid supports with different DNA barcode tags and the target DNA sample in a single reaction vessel;

and incubating the mixture under conditions that allow transposase activity and tagmentation of contiguous target DNA molecules on individual solid supports so as to fragment the individual contiguous target DNA molecules on different single solid supports, wherein the tagmentation on each of the single solid supports forms fragments of the respective target DNA molecule, wherein the 5' end of the first strand of the respective target DNA molecule fragments is ligated with the 3' end of the transfer-strand of the first transposon through transposition and the 5' end of the second strand of the respective target DNA molecule fragment being the reverse complement of the first strand of the respective target DNA molecule fragment is ligated with the 3' end of the transfer-strand of the second transposon, wherein the tagmentation conditions are selected to result in target DNA molecule fragments having an average length of 300 bp to 600 bp, even more preferably 300 bp to 500 bp and most preferably 400 bp;

(b) washing the solid supports;

(c) remove the transposase proteins from the solid supports;

(d) performing a gap-filling reaction on the solid supports so as to link the 3' ends of the target DNA molecule fragment strands with the respective non-transferred strands; and (e) perform a PCR reaction amplifying barcode tagged target DNA molecule fragments using the solid supports as template, preferably using a universal primer pair featuring sequences capable of attachment to flow cells during high-throughput sequencing, preferably the P5 (SEQ ID NO: 3) and P7 (SEQ ID NO: 4) primers, wherein the contiguity information of the DNA molecules comprised in the target DNA sample is maintained in that the library DNA fragments resulting from amplification of the fragments of a contiguous DNA molecule of the target DNA sample comprise a unique DNA-barcode tag provided by the barcode sequence B1 of adapter sequence A1 and the barcode sequence B2 of the adapter sequence A2 of the solid support on which tagmentation of a respective target DNA mol- 5 ecule occurred.

33. The method of item 32, wherein the method further comprises:

(b') removing excess transposons from the solid supports that were not assembled into transposomes and/or 10 transposomes that have not tagmented the said target DNA molecule; and (b") washing the beads.

34. A DNA sequencing method for determining contiguous sequence information from a target DNA sample, 15 comprising:

a) generating a DNA sequencing library with the steps as defined in item 32 or 33;

b) performing DNA sequencing with the generated DNA sequencing library, wherein sequence information of 20 the target DNA molecule fragments and the respective sequence of the DNA-barcode tags comprising of the respective barcode sequences B1 and B2 thereto is determined; and c) determining which target DNA molecule fragments are 25 derived from which target DNA molecule, wherein step c) comprises:

detect the sequences of the z barcode segments of the barcodes B1 and the g barcode segments of the barcodes B2; 30 perform error detection and correction individually on each of the barcode segments;

determine the DNA-barcode tags based on the error corrected barcode segment sequences and assign the DNA molecule fragments having the same barcode 35 tag to be comprised in a contiguous target DNA molecule.

35. The method of item 34, wherein step c) is performed computer-implemented.

36. A computer-implemented method comprising: 40 a) providing DNA sequencing data as obtainable by steps a) and b) of item 34; and b) performing the steps as defined in step c) of item 34 so as to demultiplex the barcode information.

37. A computer program product or a computer-readable 45 medium comprising instructions which, when executed by a computer, cause the computer to carry out the steps as defined in step c) of item 34 on DNA sequencing data as obtainable by steps a) and b) of item 34.

38. A method for producing a mixture of beads as defined 50 in any one of items 1 to 22, comprising:

assembling the multiple identical copies of the solid-support specific set of two transposons on the at least 1 million solid supports by a stepwise split-and-pool ligation assembly of a set of DNA molecules, 55 wherein said set of DNA molecules consists of first set of double stranded DNA molecules for assembling the first transposons and a second set of double stranded DNA molecules for assembling the second transposons, 60 wherein the first set of DNA molecules consists of z subsets of DNA molecules, wherein z is 2, 3 or 4, wherein a first subset A of the z subsets of the first set of DNA molecules consists of DNA molecules that each comprise a common solid-support 65 attachment site on the first end and one of the $x_1$ nucleic acid sequences for the first barcode segment of the z barcode segments of the barcode sequences B1 and a single stranded overhang of one or two nucleotides on the opposite second end, wherein a second subset C of the z subsets of the first set of DNA molecules consists of DNA molecules that each comprise one of the $x_z$ last barcode segments of the barcodes sequences B1 and a single stranded overhang of one or two nucleotides that is reverse complementary to the overhang of the DNA molecules of the subset A or the second to the last barcode segments of the barcode sequence B1 on one end and a transposase recognition site on the opposite second end, wherein, when z≥3, the other subsets of the z subsets of DNA molecules consist of the $x_z$ to $x_{z-1}$ sequences having on both ends single stranded overhangs being reverse complementary with the overhangs of the adjacent barcode segments, respectively, wherein the second set of DNA molecules consists of g subsets of DNA molecules, wherein g is 2, 3 or 4, wherein a first subset B of the g subsets of the second set of DNA molecules consists of DNA molecules that each comprise a common solid-support attachment site on the first end and one of the $k_1$ nucleic acid sequences for the first barcode segment of the g barcode segments of the barcode sequences B2 and a single stranded overhang of one or two nucleotides on the opposite second end, wherein a second subset D of the g subsets of the second set of DNA molecules consists of DNA molecules that each comprise one of the $k_g$ last barcode segments of the barcodes sequences B2 and a single stranded overhang of one or two nucleotides that is reverse complementary to the overhang of the DNA molecules of the subset B or the second to the last barcode segments of the barcode sequence B2 on one end and a transposase recognition site on the opposite second end, wherein, when g≥3, the other subsets of the g subsets of DNA molecules consist of the $k_z$ to $k_{g-1}$ sequences having on both ends single stranded overhangs being reverse complementary with the overhangs of the adjacent barcode segments, respectively, wherein at least one ligation, preferably all ligations, in the split-and-pool assembly is/are catalyzed by a TA-ligase.

39. The method of item 38, wherein the attachment to the solid supports is mediated by one strand of the transposons, and wherein the method further comprises:

(i) removing the other strand of the transposons wherein said removing comprises melting in the presence of a sodium hydroxide solution, wherein the sodium hydroxide concentration is between 0.1 M and 0.15 M, preferably 0.15 M (ii) washing the solid supports of step (i); and (iii) hybridizing a 5' phosphorylated single-stranded oligonucleotide consisting of the reverse complementary sequence of the transposase recognition sequence to the single stranded sequences so as to generate transposons having a transfer and non-transfer strand.

40. The method of item 38 or 39, wherein z=2 and g=2, wherein for the split-and-pool ligation the DNA molecules of subset A and the DNA molecules of subset C are ligated using a first reverse complementary single nucleotide overhang pair and the DNA molecules of subset B and the DNA molecules of subset D are ligated using a second reverse complementary single nucleotide overhang pair.

41. The method of item 40, wherein the assembly order of the split-and-pool ligation is (i) DNA molecules of subset A, (ii) DNA molecules of subset B, (iii) DNA molecules of subset C and (iv) DNA molecules of subset D, wherein the first and the second reverse complementary single nucleotide overhang pairs comprise different nucleotides, and wherein optionally the assembly steps (i) and (ii) are replaced by providing solid supports having the respective pairs of DNA molecules A and B pre-attached.

42. The method of item 40, wherein the assembly order of the split-and-pool ligation is (i) DNA molecules of subset A, (ii) DNA molecules of subset C, (iii) DNA molecules of subset B and (iv) DNA molecules of subset D, wherein the first and the second reverse complementary single nucleotide overhang pairs are the same or different, and wherein optionally the assembly step (i) is replaced by providing solid supports having the respective pairs of DNA molecules A and B pre-attached.

43. The method of any one of items 38 to 42, wherein the produced mixture of solid supports is a mixture of beads for on-bead-tagmentation, and wherein the method further comprises binding transposase to the transposase recognition sequences.

44. A method for split-and-pool ligation assembly of solid support attached segmented barcodes, wherein the adjacent barcode segments are ligated via reverse complementary pairs of base pair overhangs of a length of one or two nucleotides, wherein the ligation of the one base pair overhangs is catalyzed by a TA ligase.

45. A method for producing solid supports with attached solid support specific segmented DNA barcode sequences, wherein the barcode segments of the barcode sequences are directly linked to each other, and wherein said method comprises:

a) providing solid supports in a plurality of reaction compartments, wherein each solid support has multiple identical copies of a single stranded DNA oligonucleotide selected from a predefined set of single stranded DNA oligonucleotides A attached thereto, wherein the oligonucleotides are attached to a solid support via the one end, the end being the 5' or the 3' end for all oligonucleotides, and wherein the oligonucleotides have a free second end that is formed by a barcode segment A;

b) ligating in each of the reaction compartments a polynucleotide selected from a predefined set of polynucleotides B to the free end of the solid support-attached single-stranded oligonucleotides, wherein each of the polynucleotides of the set B comprises a double stranded section and a single stranded section, wherein the single stranded section is reverse complementary to the free end of the solid support-attached single-stranded oligonucleotides of set A and comprises universal nucleotides at the positions being reverse complementary to the barcode segment A, wherein the single stranded section comprises 6 to 20, preferably 8 to 15 and most preferably 10 to 13 nucleotides other than the universal nucleotides, wherein the double stranded section comprises a barcode segment B positioned directly at the end facing the single stranded section, wherein the polynucleotides of the set B differ in the sequence of the barcode segment B, preferably by at least two base pairs; and c) removing the strands originating from the single stranded section from the solid supports by exonuclease digestion so as to generate on the solid supports single stranded oligonucleotides comprising a barcode segment A and a barcode segment B directly linked to each other.

46. The method of item 45, wherein the method further comprises washing the solid supports in each of the reaction compartments once or more after steps b) and/or c).

47. The method of item 45 or 46, wherein the double stranded section of the polynucleotides of set B further comprise a type IIS restriction enzyme recognition site, the recognition site being positioned so that a type IIS restriction enzyme cuts at the end of the barcode segment B so that the barcode segment remains attached to the solid support; and the method further comprises between steps b) and c):

b') digesting the solid support-attached ligation products of step b) with the type IIS restriction enzyme recognizing the type IIS restriction enzyme recognition site so as to remove the double stranded section of the polynucleotides B from the solid supports.

48. The method of item 47, wherein the type IIS restriction enzyme recognition site and the type IIS restriction enzyme are selected so that the 5' end of the barcode segment after the digestion is 5' phosphorylated.

49. The method of item 47 or 48, wherein the type IIS restriction enzyme recognition site is a SapI site and type IIS restriction enzyme is SapI, or wherein the type IIS restriction enzyme recognition site is a MlyI site and type IIS restriction enzyme is MlyI.

50. The method of any one of items 47 to 49, wherein the method further comprises washing the solid supports between steps b') and c) once or more.

51. The method of any one of items 45 to 50, wherein the method further comprises pooling the solid supports after step c).

52. The method of any one of items 45 to 51, wherein all the polynucleotides of set B comprise an identical sequence stretch of 4 to 50 nucleotides at the end of the double stranded section opposite the single stranded section and, wherein the method further comprises:

d) hybridizing to the single stranded oligonucleotides of step c) an oligonucleotide comprising a sequence being reverse complementary to the sequence of the identical sequence stretch so as to produce a double stranded end.

53. The method of item 52, wherein the identical sequence stretch comprises a transposase recognition sequence, preferably a ME transposase recognition sequence, even more preferably a transposase recognition sequence as defined by nucleotide positions 15 to 33 of SEQ ID NO: 9 or nucleotide positions 16 to 34 of SEQ ID NO: 10, so that the hybridization step in item 52 forms a first transposon.

54. The method of item 51, wherein the method further comprises:

d) distributing the pooled solid supports into a plurality of reaction compartments; and e) ligating in each of the reaction compartments of d) a polynucleotide selected from a set of predefined polynucleotides C to the free end of the solid support-attached single-stranded oligonucleotides, wherein each of the polynucleotides of the set C comprises a double stranded section and a single stranded section, wherein the single stranded section is reverse complementary to the free end of the solid support-attached single-stranded oligonucleotides produced in step c) and comprises universal nucleotides at the positions being reverse complementary to the barcode segments A and B, wherein the single stranded section comprises 6 to 20, preferably 8 to 15 and most preferably 10 to 13 nucleotides other than the universal nucleotides, wherein the double stranded section comprises a barcode segment C positioned directly at the end facing the single stranded section, wherein the polynucleotides of the set C differ in the sequence of the barcode segment C, preferably by at least two base pairs; and f) removing the strands originating from the single stranded section from the solid supports by exonuclease digestion so as to generate on the solid supports single stranded oligonucleotides comprising a barcode segment A, a barcode segment B and a barcode segment C, wherein the barcode segments A and B are directly linked to each other and the barcode segments B and C are directly linked to each other.

55. The method of item 54, wherein all the polynucleotides of set C comprise an identical sequence stretch of 4 to 50 nucleotides at the end of the double stranded section opposite the single stranded section and, wherein the method further comprises:

g) hybridizing to the single stranded oligonucleotides of step f) an oligonucleotide comprising a sequence being reverse complementary to the sequence of the identical sequence stretch so as to produce a free double stranded end.

56. The method of item 55, wherein the identical sequence stretch comprises a transposase recognition sequence, preferably a ME transposase recognition sequence, even more preferably a transposase recognition sequence as defined by nucleotide positions 15 to 33 of SEQ ID NO: 9 or nucleotide positions 16 to 34 of SEQ ID NO: 10, so that the hybridization step in item 55 forms a first transposon.

57. The method of any one of items 45 to 56, wherein step a) comprises producing the solid supports by attaching the oligonucleotides of set A to the solid supports. Optionally, when two or more different oligonucleotides of the set of oligonucleotides A are used, each of the different oligonucleotides is attached in separate reaction compartments. This ensures that only multiple identical copies of the same oligonucleotide are attached to each solid support. After attachment the beads may be pooled (and mixed) and distributed into multiple reaction compartments so that the solid supports of step a) are provided.

58. The method of any one of items 45 to 57, wherein the solid supports contained in a first of the reaction compartments in a) differ from the solid supports contained in a second of the reaction compartments in a) in that the barcode segment A differs in its sequence, preferably by at least two nucleotides.

59. The method of any one of items 45 to 58, wherein the solid supports the different reaction compartments differ from each other in that the barcode segment A of the attached single stranded oligonucleotides differs in its sequence, preferably by at least two nucleotides.

60. The method of any one of items 45 to 59, wherein the barcode segment A has a length of 4 to 9 nucleotides, the barcode segment B has a length of 4 to 9 base pairs, and/or the barcode segment C has a length of 4 to 9 base pairs.

61. The method of any one of items 45 to 60, wherein the ligation in step b) and/or step e) is performed with a TA-ligase, preferably a Blunt/TA ligase.

62. The method of any one of items 45 to 61, wherein the oligonucleotides of the set A comprise a sequencing adapter A1 between the attachment site and the barcode segment A, preferably wherein said adapter sequence A1 comprises a first sequencing library amplification primer site.

63. The method of any one of items 45 to 62, wherein the oligonucleotides of set A are attached to the solid supports via their 5' end.

64. The method of item 63, wherein the strand not having a single stranded portion of the polynucleotides of set B and/or set C is 5' phosphorylated.

65. The method of item 63 or 64, wherein the exonuclease in step c) and/or step f) is a 3' to 5'-exonuclease, preferably Exo III.

66. The method of any one of items 45 to 62, wherein the oligonucleotides of set A are attached to the solid supports via their 3' end.

67. The method of item 66, wherein the 5' end of the oligonucleotides of set A are 5' phosphorylated.

68. The method of item 66 or 67, wherein the strand not having a single stranded portion of the polynucleotides of set B and/or set C is 5' phosphorylated.

69. The method of any one of items 66 to 68, wherein the exonuclease in step c) and/or step f) is a 5' to 3'-exonuclease, preferably λ exonuclease.

70. The method of any one of items 45 to 69, wherein the attachment of the oligonucleotides of set A to the solid support is mediated by a binding pair, preferably selected from biotin-avidin and biotin-streptavidin, wherein one member of the binding pair is attached at the solid support-attached oligonucleotide end.

71. The method of any one of items 45 to 70, wherein the oligonucleotides of set A have a linker sequence at the solid support-attached oligonucleotide end.

72. The method of any one of items 45 to 71, wherein the method further comprises:

h) distributing the produced solid supports into a plurality of different reaction compartments; and i) attaching to each of the solid supports in each of the reaction compartments multiple copies of a second barcoded polynucleotide, preferably a second transposon, wherein in each of the plurality of reaction compartments a differently barcoded polynucleotide is attached.

73. The method of item 72, wherein the second barcoded polynucleotides are assembled by first attaching multiple identical copies of a single stranded oligonucleotide of a predefined set A' to each of the solid supports via their 5' or 3' end, wherein the oligonucleotides of set A' comprise a barcode segment A' at the non-solid support attached end, and a stepwise assembly of the second polynucleotides is achieved by a method as described in any one of items 16 to 42 using a predefined polynucleotide set B' instead of the predefined polynucleotide set B and optionally a predefined poly-nucleotide set C' instead of the predefined polynucle-otide set C.

74. The method of item 73, wherein the set B' of poly-nucleotides is identical with the set B of polynucle-otides, and/or wherein the set C' of polynucleotides is identical with the set C of polynucleotides.

75. The method of item 73, wherein the set B' of poly-nucleotides is identical with the set B of polynucle-otides with the exception that the barcode segments have a different sequence, and/or wherein the set C' of polynucleotides is identical with the set C of polynucle-otides with the exception that the barcode segments have a different sequence.

76 The method of any one of items 73 to 75, wherein the sequences of the oligonucleotide set A' comprise a sequencing adapter A2 between the attachment site and the barcode segment A', preferably wherein said adapter sequence comprises a second sequencing library amplification primer site.

77. The method of any one of items 72 to 76, wherein the method is a method for producing the mixture of solid supports according to any one of items 1 to 7, and wherein the sequences of the oligonucleotide set(s) and polynucleotide set(s) are configured accordingly.

78. The method of any one of items 45 to 77, wherein the finally assembled polynucleotide(s) on the solid sup-ports is/are transposon(s), and wherein the method further comprises binding a transposase (e.g. a Tn5 transposase or any other transposase mentioned herein) to the transposon end.

79. The method of any one of items 45 to 78, wherein the method comprises as final step washing the generated solid supports once or more, and/or pooling the gen-erated solid supports and/or collecting the generated solid supports.

80. The method of any one of items 45 to 79, wherein the solid supports are microbeads.

81. The method of any one of items 45 to 80, wherein the method comprises one or more washing steps between each of the steps.

The appended Figures illustrate the present invention in a non-limiting manner and/or show results of the experiments conducted in the appended Examples. Any embodiments shown in the Figures are non-limiting.

FIG. 1 illustrates a preferred design of the haplotagging solid support, exemplified as a bead. A bead, such as a M-280 streptavidin-coated paramagnetic Dynabead, is used as a solid support to the Tn5 transposons, which is attached through binding with binding moiety, such as a biotinylated moiety (2). Extending from the biotin moiety are two possible types of oligonucleotides A and B, connected by flexible poly-T 34 and 35 nt long linkers (3 and 4, respec-tively). The main Tn5 heteroadapters are shown as stylized arrows pointing from the 5' to 3' direction. They are mostly single-stranded and consist of the following key sections from 5' to 3': P7 capture sequence SEQ ID NO: 4 (fragment, from position 5 to 24), an i7 index segment, itself consisting of barcode segment "A" (6 nt), a linker segment "L1" of one or two nucleotides in length, and a barcode segment "C" (6 nt), followed by a Tn5A transposon sequence, which may correspond to the sequence Tn5ME-A SEQ ID NO: 9 in the sequence listing. This last part of the adapter corresponds to the transfer strand of the Tn5 transposon, and is presented as a duplex segment via annealing to the 5' phosphorylated Tn5MErev SEQ ID NO: 11. The second adapter of the Tn5 heteroadapter preferably carries from the 5' to the 3' direction the following segments: P5 capture sequence SEQ ID NO: 3 (fragment, from position 11 to 25), an i5 index segment, itself consisting of barcode segment "B" (6 nt), a linker segment "L2" of one or two nucleotide long, and a barcode segment "D" (6 nt), followed by a Tn5B transposon sequence, which may be identical to the sequence Tn5ME-B SEQ ID NO: 10 in the sequence listing. This last part of the adapter corresponds to the transfer strand of the Tn5 trans-poson, and is presented as a duplex segment via annealing to the 5' phosphorylated Tn5MErev SEQ ID NO: 11. These two adapters can be brought into a "loaded Tn5 transpo-some" complex by binding to a Tn5 transposase (5). The loaded Tn5 transposome, in the presence of $Mg^{2+}$ ions and target substrate, can transpose and insert its transfer strand sequences into target DNA molecules. This is the enzymatic means by which target DNA molecules can be tagmented and made into sequencing compatible fragments flanked by adapter sequences.

Figure 2:
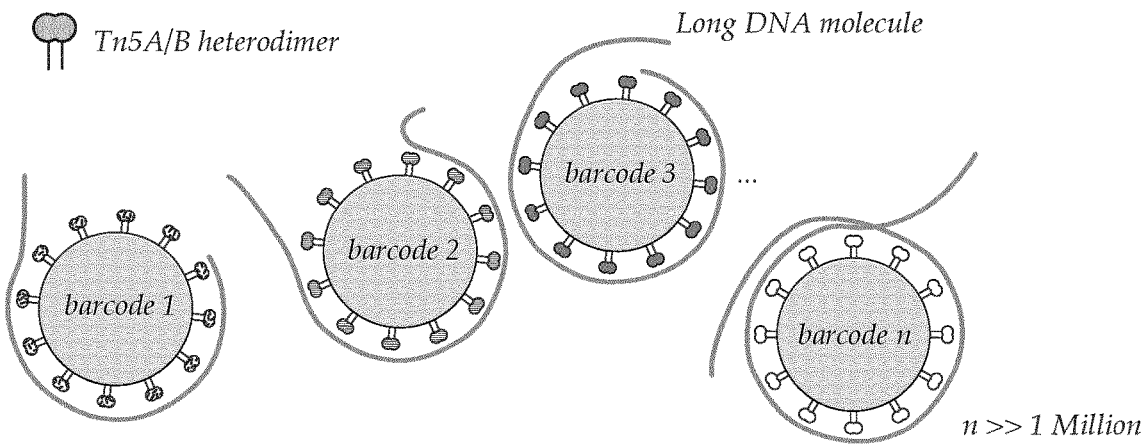

FIG. 2 illustrates the concept of the present invention, also referred to as "haplotagging" herein. Specifically, FIG. 2 is a schematic drawing illustrating a preferred tagmentation process using beads as shown in FIG. 1. Each active Tn5A/B heterodimer duplex is shown as transposomes that are immobilized onto microbeads. The shading of the transpo-some duplexes indicates their barcode combination (bead-Tag). The figure shows that each bead is coated with a single type of transposome complex, and the bead itself is brought into contact with long target DNA molecules. The major mode of molecular interactions is expected to be between a single bead and a target DNA molecule, such that the same barcode is added to the target DNA molecule via Tn5 transposition reactions. With sufficient diversity of at least one million distinct barcodes, it is expected that most target DNA molecules can be uniquely tagged by a single barcode.

Figure 3:
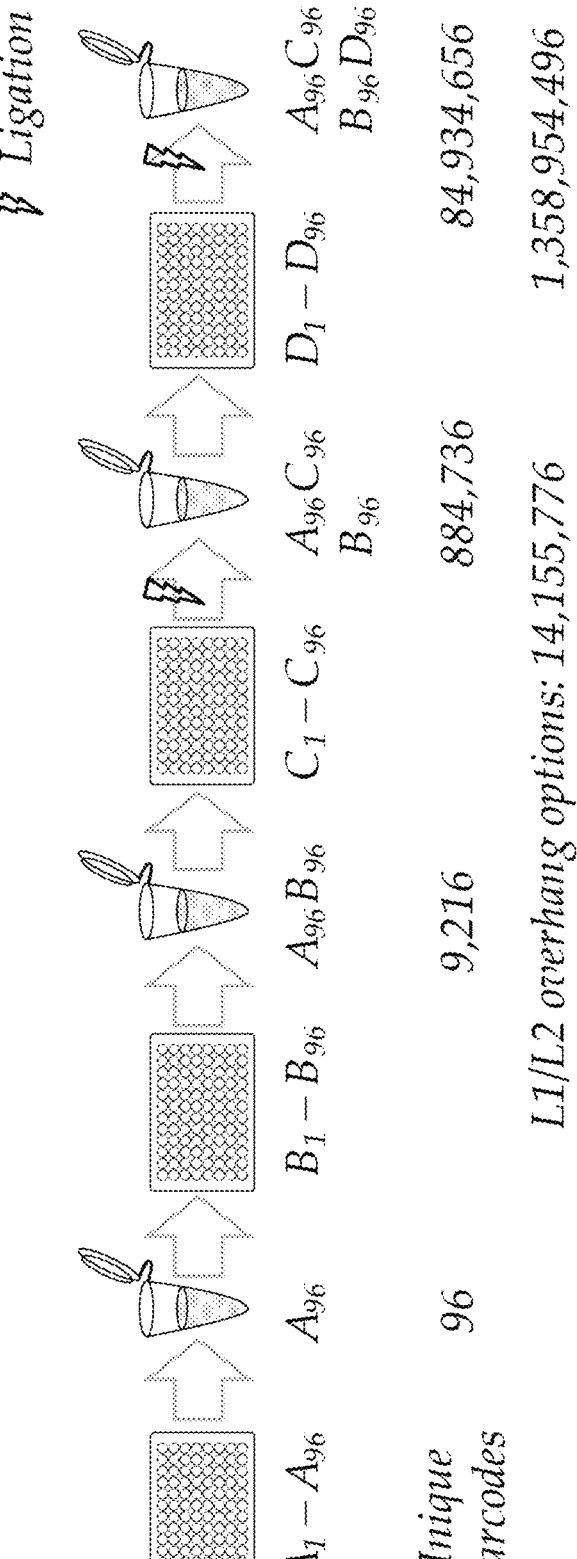

FIG. 3 schematically illustrates an exemplary split-and-pool assembly process of the mixture of solid supports (preferably "haplotagging beads") according to the present invention, in particular as shown in FIGS. 1 and 2. The process is exemplary illustrated with beads but can be expanded also to solid supports of any shape. In this procedure, four sets of DNA adapters designed duplex "A", "B", "C" and "D" are shown in a 96-well plate format. Starting with the A duplexes, beads are added to each well of the 96-well plate, such that they are coated with a single type of duplex A. The entire plate of beads was then pooled and split into the next plate containing duplexes $B_1$-$B_{96}$. This process was then repeated for the duplexes C and D, with the use of Blunt/TA ligases due to the short, 5' overhang of only 1 to 2 nt in length. This design was optimized to minimize the total length of the two segmental barcode sequences (which has the advantage that they can be placed in the indexing i5 and i7 position, respectively) such that the resulting sequencing library could be processed under stan-dard Illumina® sequencing conditions without custom modifications. The number of unique combinatorial barcode is indicated below, showing that the segments A, B and C can together encode 884,736 unique combinations, and with all four segments A, B, C and D a total of 84,936,656 unique combinations can be encoded. If the X and Y overhang positions are further varied, the diversity can be as high as 1,358,954,496.

Figure 4:
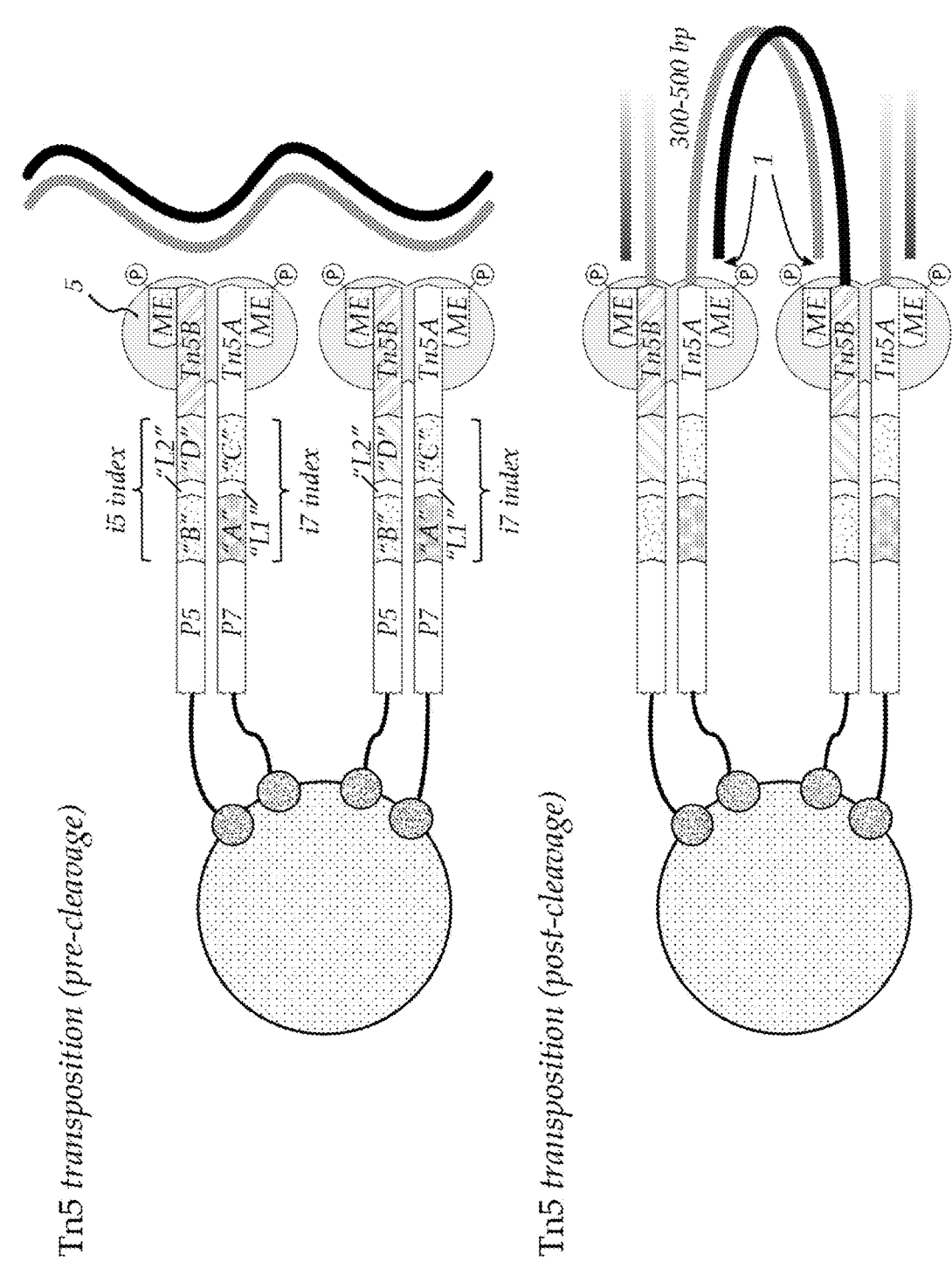
Figure 4:
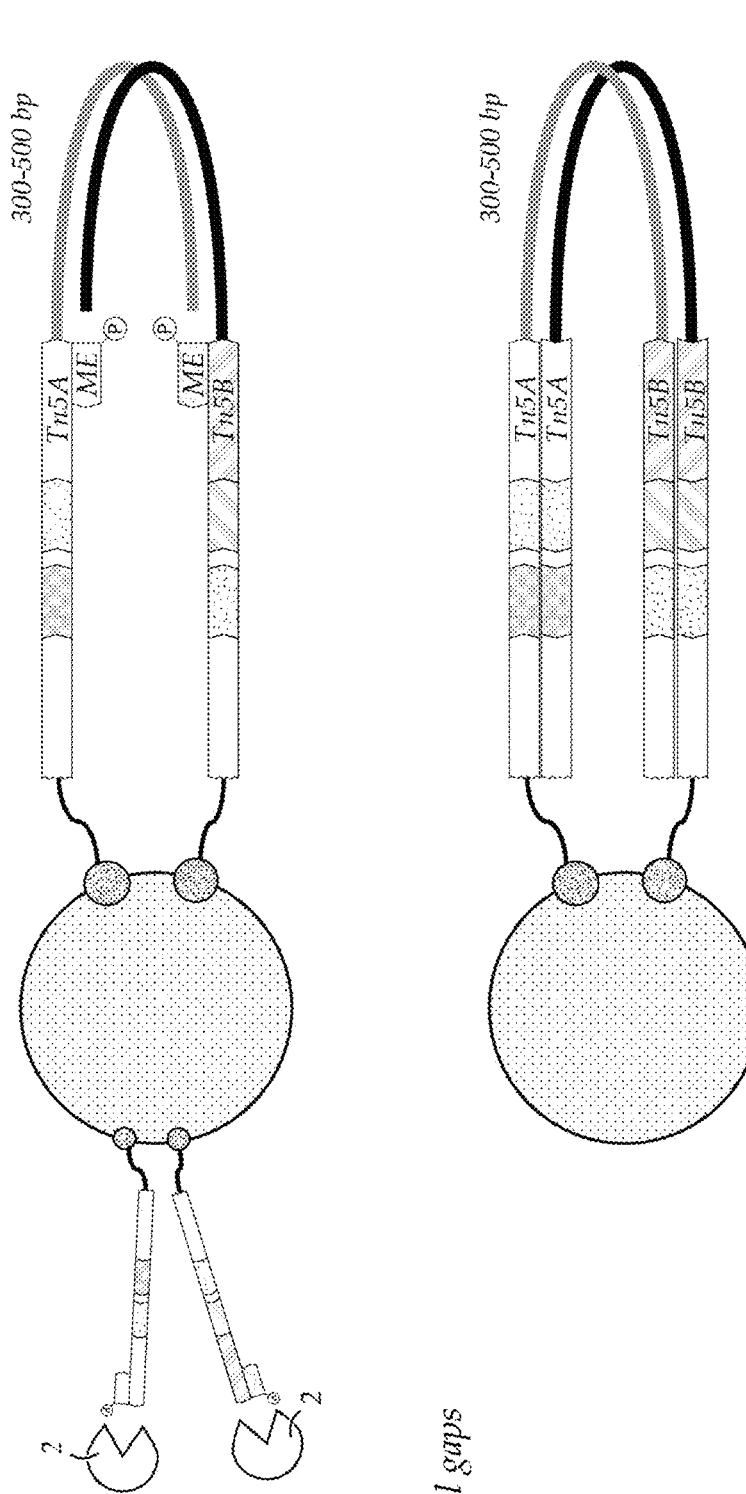
Figure 4:
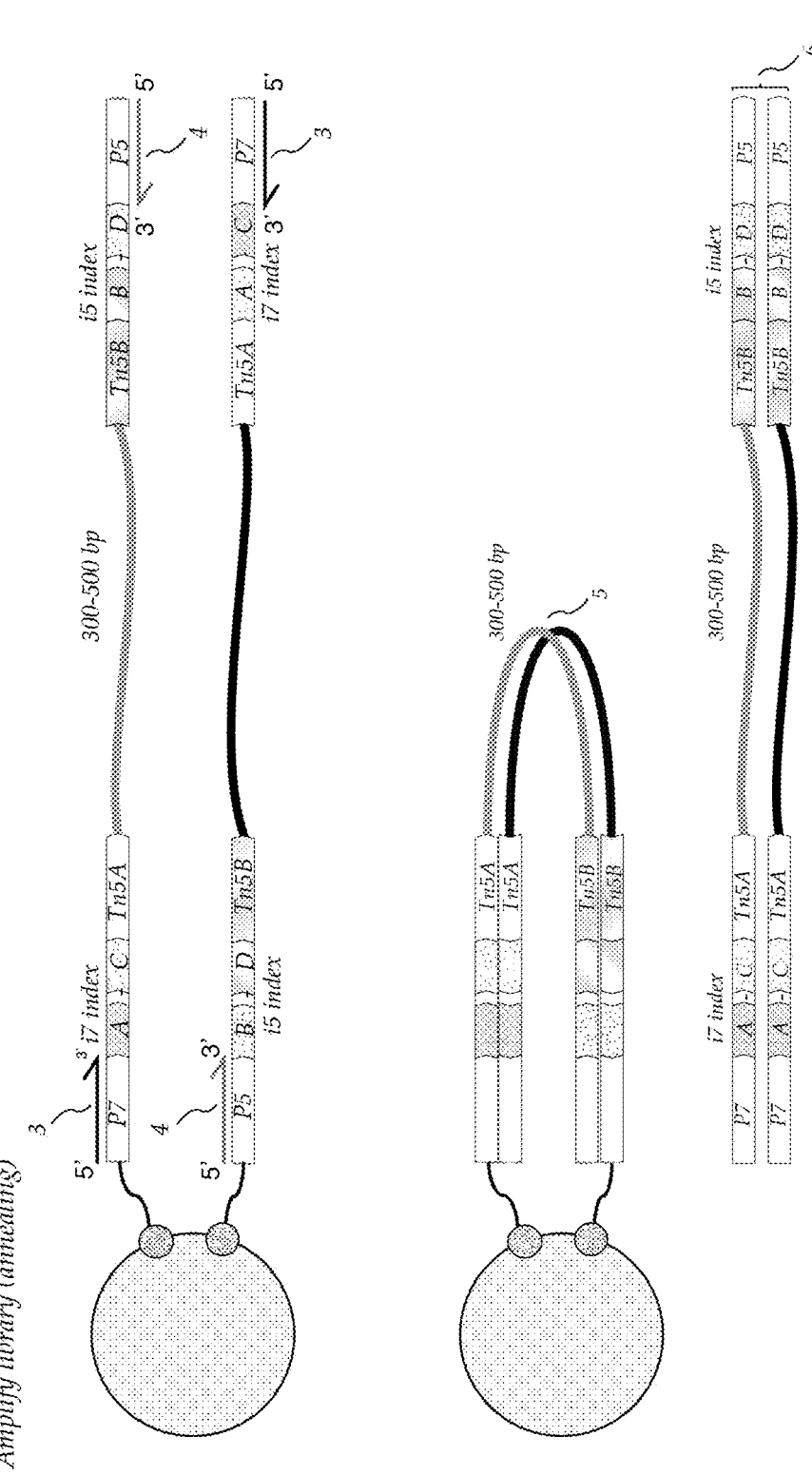

FIG. 4 illustrates schematically the main biochemical steps during the preparation of a sequencing library using a mixture of solid supports according to the present invention. The configuration of the solid supports shown in the Figure is non-limiting and any other configuration of the solid supports according to the present invention may be employed instead. For simplification, the biochemical steps are only illustrated for an individual solid support (here exemplary illustrated as bead). The shown process occurs, however, on multiple beads of the mixture of beads so that different bead-specific DNA barcode tags are attached to the target DNA fragments. In Step 1, the target DNA (shown as two unwound strands in grey and black on the right) is presented to the haplotagging bead (left, shown with only two heteroadapter duplexes for clarity). The details of the haplotagging bead may otherwise be identical to that depicted in FIG. 1.

Step 1 ends with the tagmentation step, in which Tn5 transposition occurs with strand transfer of the Tn5A and Tn5B transposons (i.e. the first and second transposons of a bead-specific transposon pair).

Step 2 shows the relevant configuration of the heteroadapter and the target DNA molecule immediately after Tn5 transposition. In the target DNA on the un-transferred strand, there is a 9 nt gap in the DNA, leaving the 5' phosphorylated end of the Tn5MErev SEQ ID NO: 11 primer unincorporated (1). Should the target DNA be cleaved or let to denature at this point, it may become impossible to reattach primer adapter(s) to this exposed end. To achieve an appropriate target DNA tagmentation interval of about 300-600 bp, the amount of immobilized Tn5 transposome duplex was optimized in Example 4.

At this step, an optional biochemical digestion step was introduced in Step 3 to take advantage of the contrasting presentation of various used and unused Tn5 transposon duplexes to minimize the concentration of other undesirable primer pairing in subsequent steps. The experiments are detailed in Example 13, in which the 9 nt gap was used as a protecting configuration such that only truly undesirable primers/oligonucleotides were removed through the combined use of lambda exonuclease (5'-to-3' digestion of double-stranded DNA) and exonuclease I (3'-to-5' digestion of single-stranded DNA exposed by lambda exonuclease, sectors labelled "2"). As a result, only genuinely tagmented target DNA remains as the double-stranded DNA substrate for gap filling reaction (Step 4).

Here the use of a polymerase, which has the ability to ligate 5' phosphorylated DNA as well as elongation of DNA template, such as Q5 polymerase, allows the complete filling of the 9 nt gap and the remaining part of the heteroadapters. This results in template that can be amplified with standard library amplification primers, such as the standard universal amplification primers P5 and P7 primers (SEQ ID NO: 3 and 4, and labeled as "3" and "4", respectively). The amplified PCR products are now ready for sequencing, with the original target DNA template remaining intact on the beads. It is anticipated that additional procedures can be performed on the beads to isolate specific sequences for further PCR amplification and sequencing.

Figure 5:
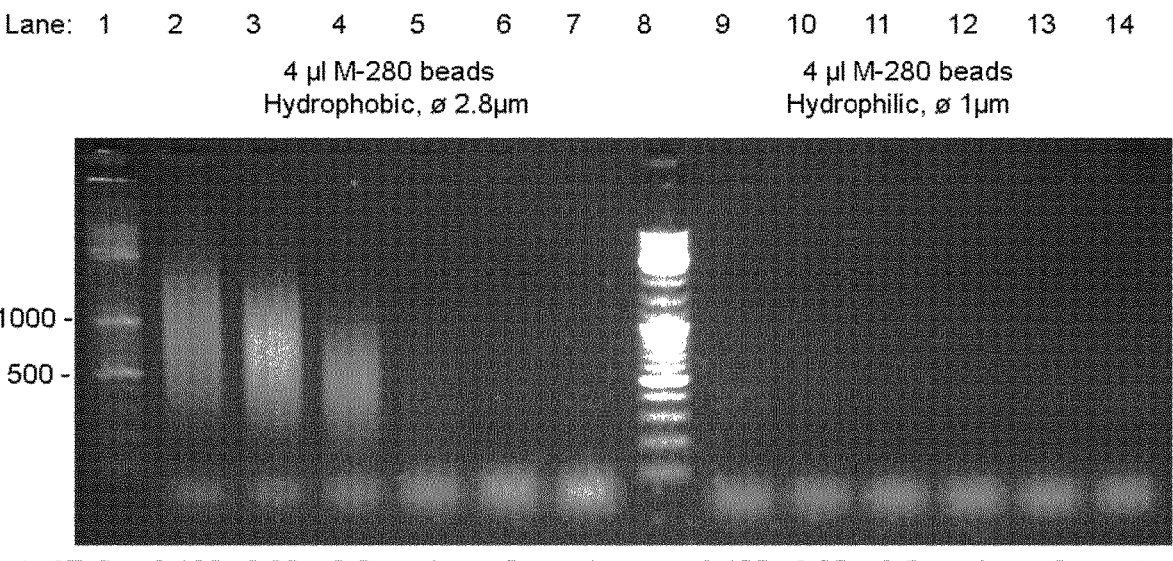

FIG. 5 shows the result from tagmentation of 10 ng of genomic DNA with varying concentration of Tn5 transposomes bound to two different types of beads. Lanes 1 and 8 of the agarose electrophoresis gel show standard DNA size markers (1 kb Plus DNA ladder from New England Biolabs®). Lanes 2-7 show the resulting PCR amplified DNA from varying input Tn5 concentration (0.125, 0.25, 0.5, 1, 2 and 4 µl input) immobilized on 4 µl of M-280 hydrophobic Dynabeads. The library was run in the gel to evaluate the success and insertion frequency of tagmentation. Lanes 9-14 show the result of the same, except that the Tn5 transposomes were immobilized on C1 beads.

Figure 6:
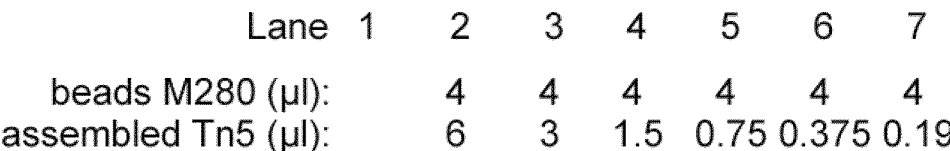
Figure 6:
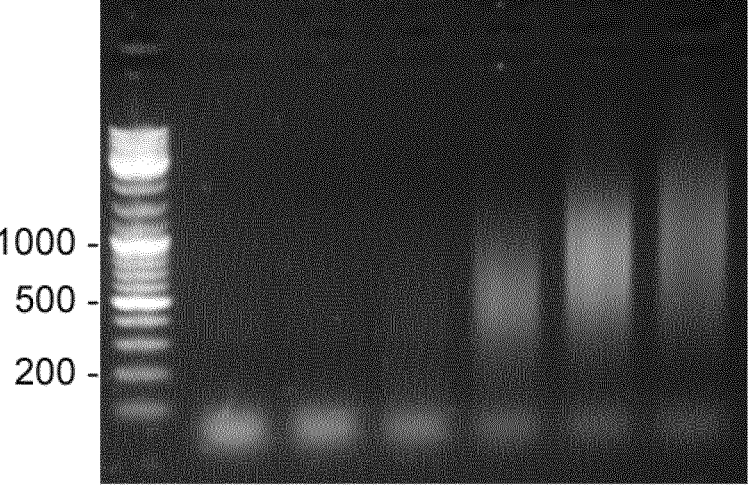

FIG. 6 shows the results from fine optimization of pre-assembled Tn5 of varying concentration from 0.19, 0.375, 0.75, 1.5, 3 and 6 µl. Lane 1 shows a standard DNA size marker, with the PCR amplified genomic libraries loaded into lanes 2-7. The library was run in the gel to evaluate the success and insertion frequency of tagmentation.

Figure 7:
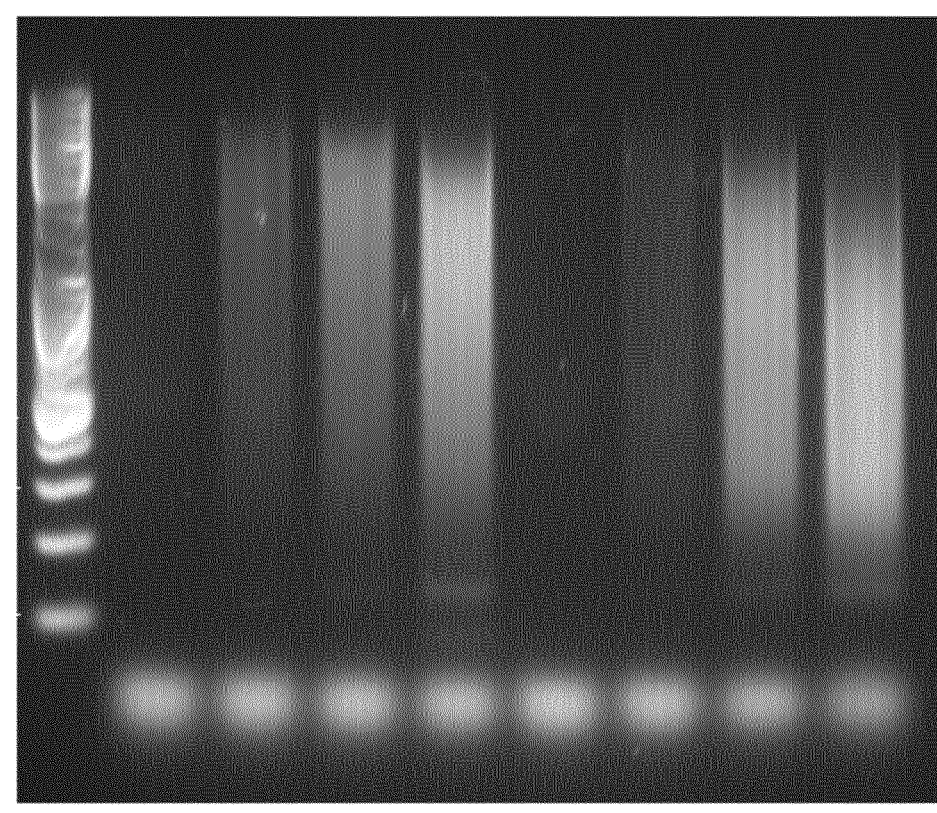

FIG. 7 shows the results from directly assembling Tn5 transposomes on microbeads as solid supports. Lane 1 shows the standard DNA size marker, and lanes 2-5 show the results from loading 0.125 µl of Tn5; and lanes 6-9 0.375 µl of Tn5. In each case, Tn5 transposon duplexes/pairs were added at a concentration of 0.1 µM, with input volumes of 2, 4, 6 and 8 µl. The PCR amplified genomic libraries were shown in the gel to evaluate the success and insertion frequency of tagmentation.

Figure 8:
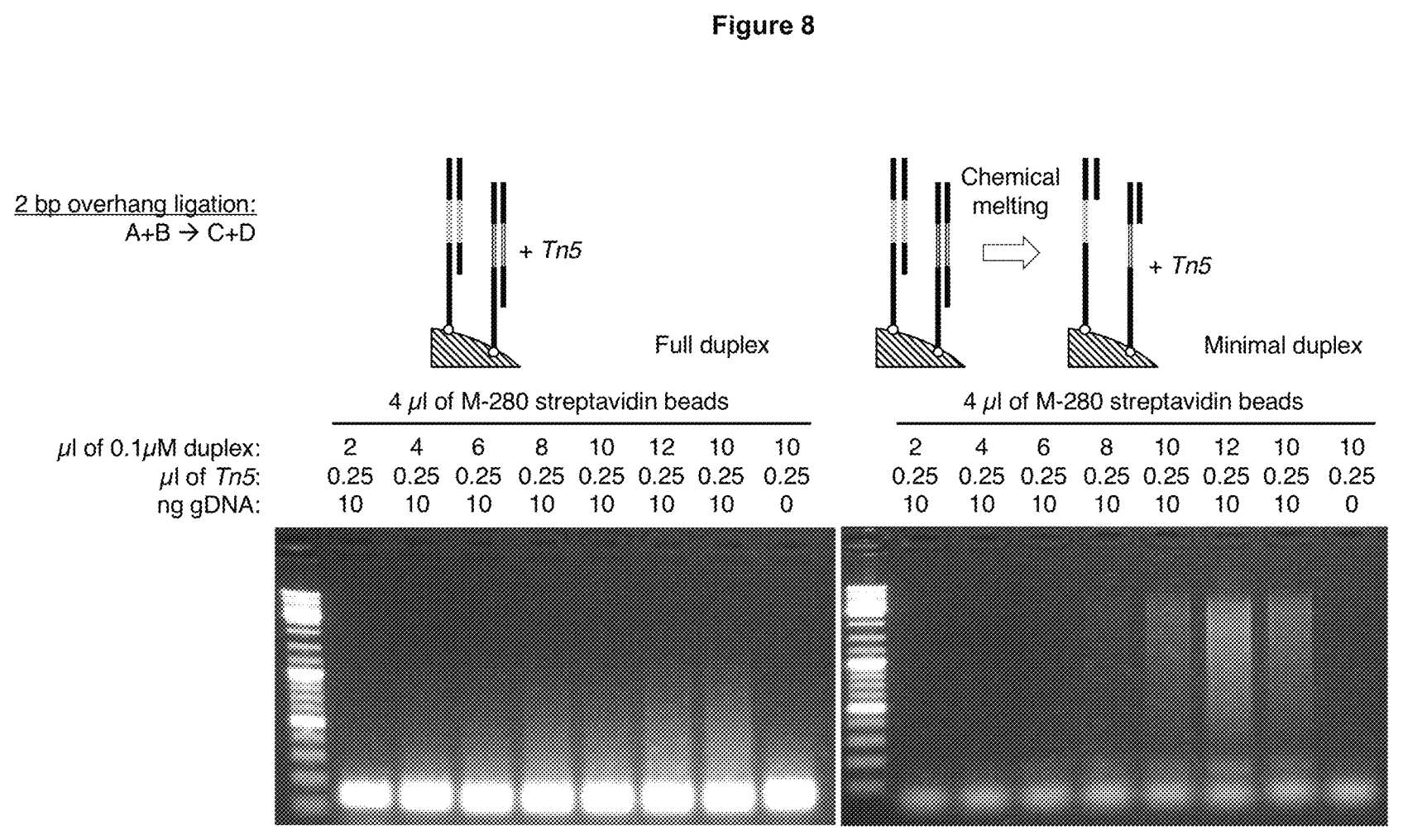

FIG. 8 shows the results from an experiment testing the requirement of a minimal Tn5 duplex for successful library generation. The Figure has two panels, with the full duplex on the left (schematic on top, and electrophoretic gel results in the bottom along with labeled input concentrations of reagents); and the minimal duplex on the right. In each panel, a schematic shows the basic structure of the Tn5 transposon complexes immobilized on solid supports. Each gel panel shows the standard DNA size marker as Lane 1, along with Lanes 2 to 8 showing PCR amplified libraries, with input duplex concentrations 2, 4, 6, 8, 10 and 12 µl of 0.1 µM duplexes, along with replicates and negative controls. The PCR amplified genomic libraries are shown in the gel to evaluate the success and insertion frequency of tagmentation.

Figure 9:
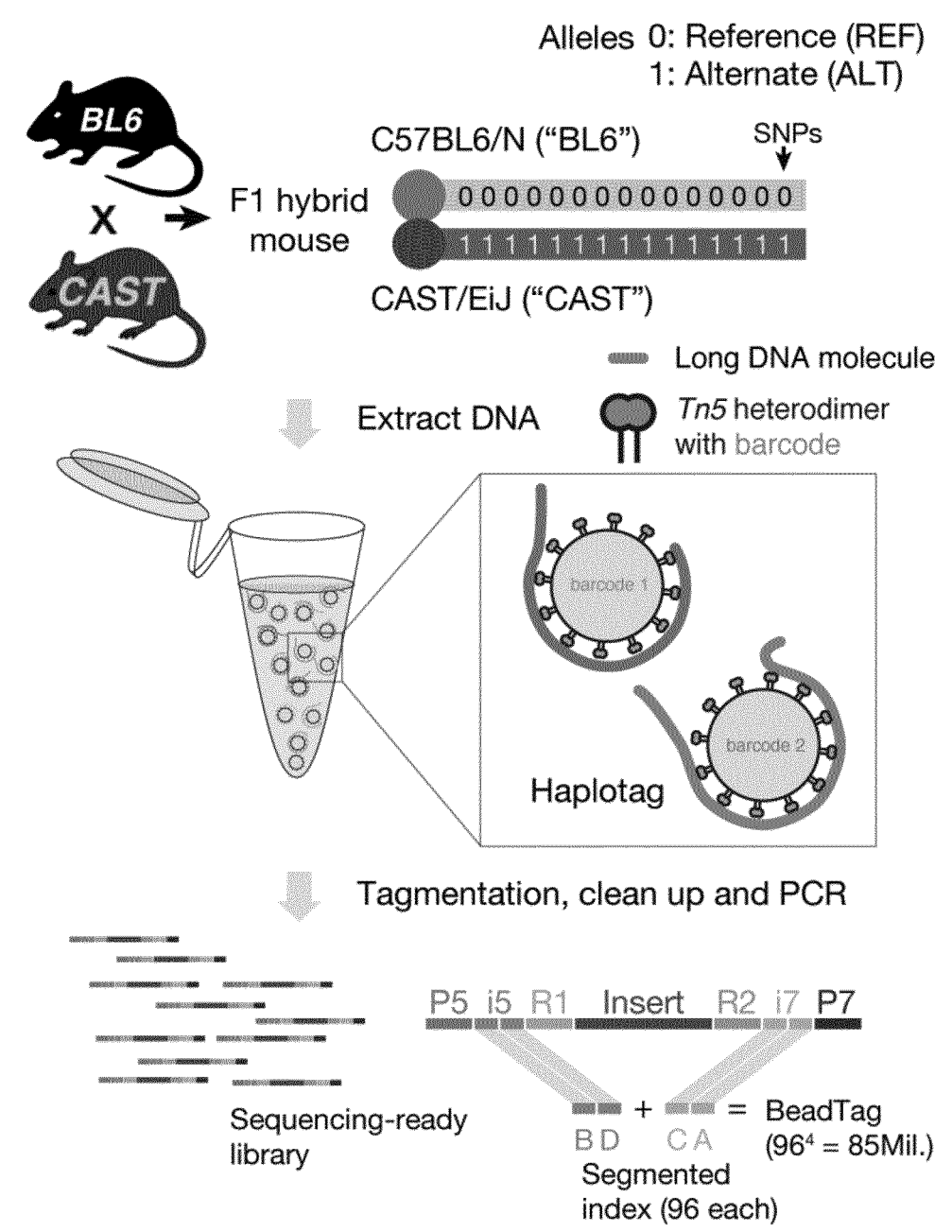

FIG. 9 shows schematically the experimental design to test the feasibility of haplotagging. As input target genomic DNA material, an experimental cross between the laboratory reference mouse strain C57BL6/N ("BL6") was set up against a male mouse of CAST/EiJ ("CAST") strain. The resulting F1 hybrid mouse should carry for each homologous chromosome pair one chromosome consisting exclusively of reference ("REF" or 0) SNP alleles, and the other alternate ("ALT" or 1) alleles. The extracted target DNA was then tagmented by bead-immobilized Tn5 heterodimers. The resulting PCR amplified fragments are then depicted schematically as "sequencing-ready library", with the main segments shown to highlight the exact correspondence to the standard Illumina® configuration for Nextera® libraries. Individual barcode segments "B", "D", "C" and "A" are shown in the order of their locations on the fragment. Together they constitute the combinatorial beadTag (also referred to as DNA-barcode tag), which can reach up to 84,934,656 combinations.

Figure 10:
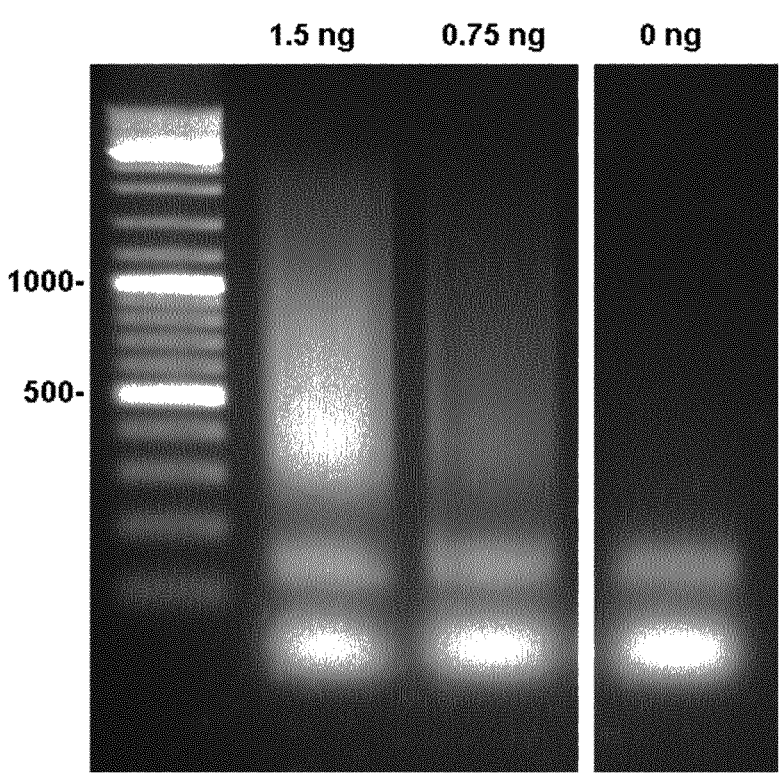

FIG. 10 shows the result from testing the on-bead ligation and Tn5 assembly, using a small set of A (4), B (4), C (8) and D (8) duplexes and a total of 1024 combinations. The gel shows the standard DNA size marker in Lane 1, with input target DNA concentration of 1.5 ng and 0.75 ng in Lanes 2 and 3. Lane 4 was a no-input negative control. Successful tagmentation was evaluated with the PCR amplified DNA library.

Figure 11:
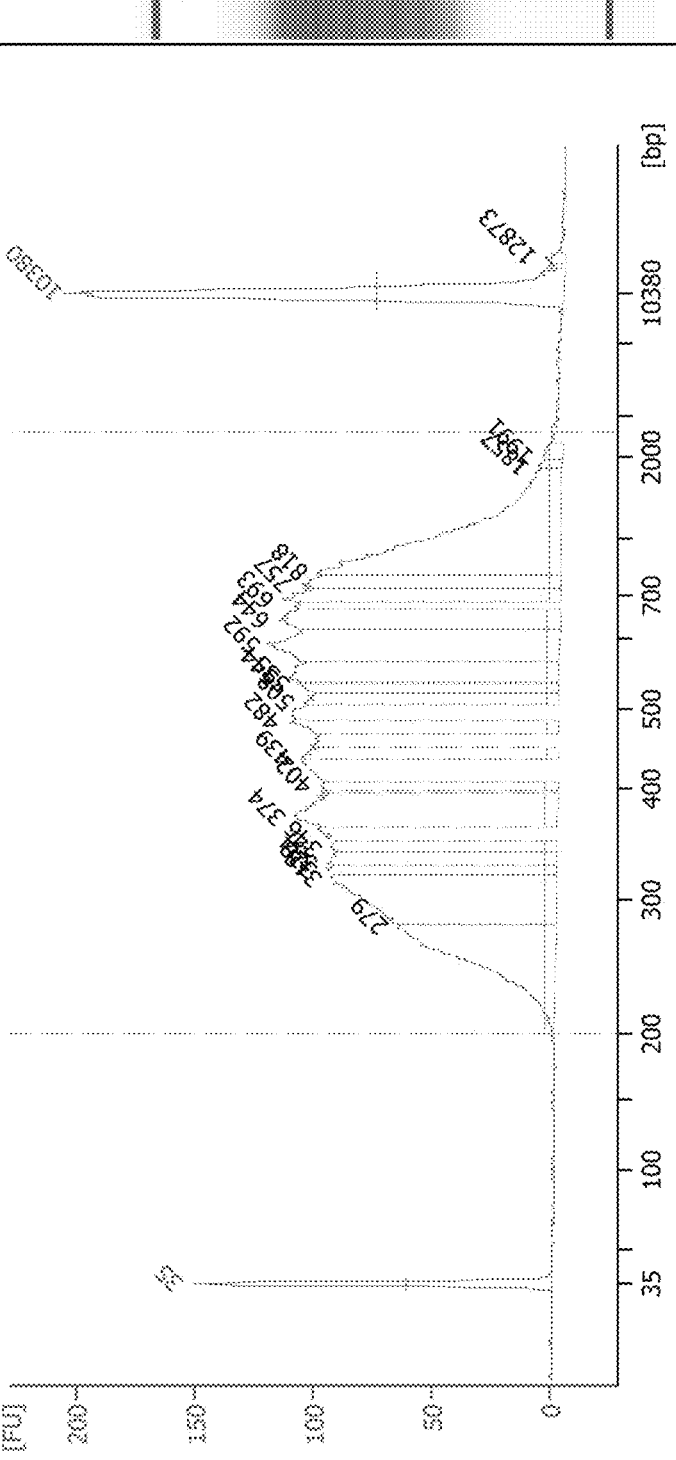

FIG. 11 shows the quantified size distribution of the haplotagged sequencing library as generated by a Bioanalyzer chip. Labels along the X-axis were DNA size estimates estimated from standard markers of size 35 and 10,380 bp. The fluorescent unit of the DNA at a given size is plotted on the Y-axis, with spikes and mounts in the graph indicating the presence of DNA at the specified size. Individual peaks were labeled with the estimated size in bp. An image rendering of the gel is shown on the right.

Figure 12:
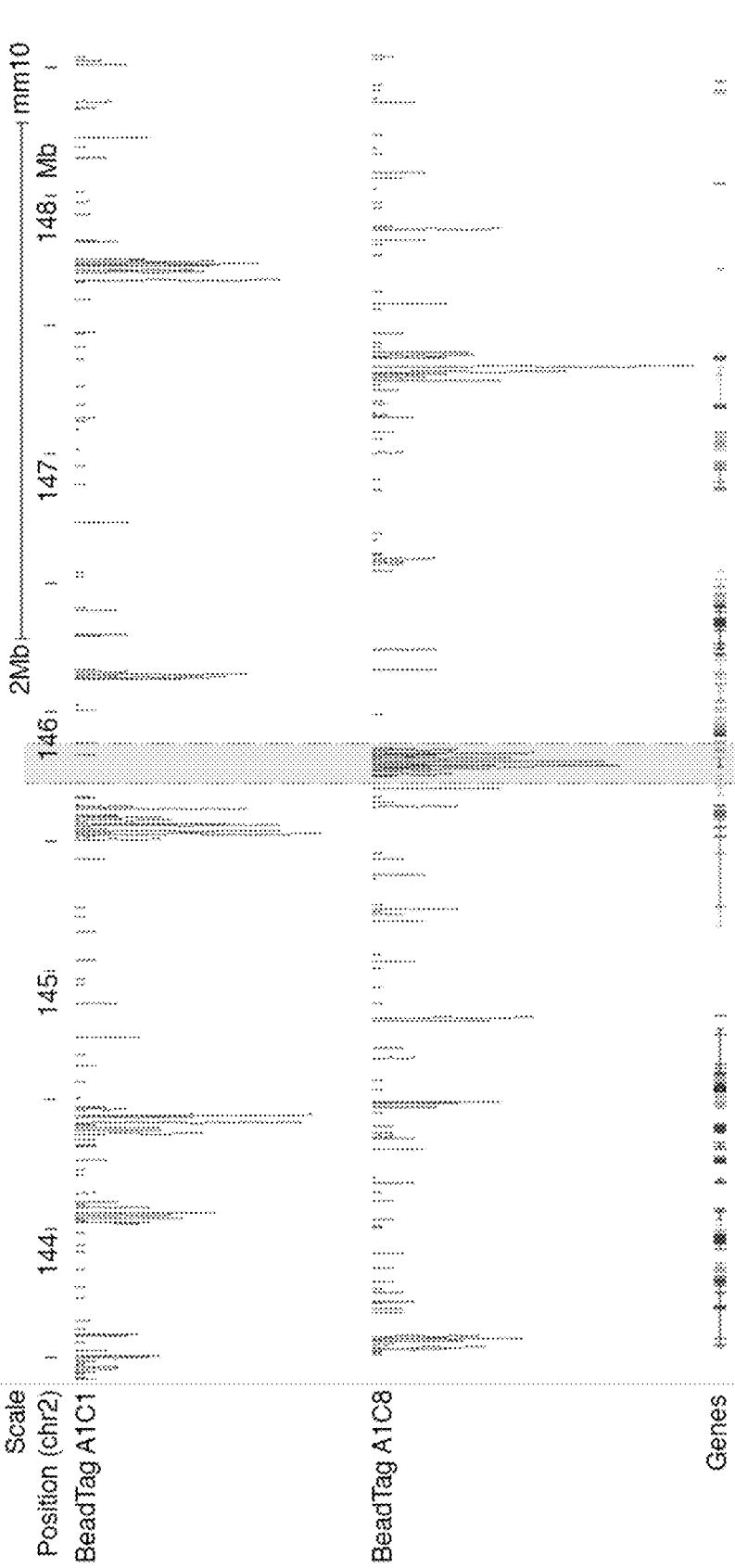

FIG. 12 shows a genome browser screenshot showing the position of mapped fragments corresponding to two different beadTags A1C1 and A1C8. The area shown covers approximately 5 Mbp from Chr2: 143.5-148.5 in the mouse genome. Each read is shown as solid bars in each horizontal data "track", with local clusters of reads appearing as downward mounts. For visual comparison gene models in the region are shown as a set of symbols (tall bars: coding exons; short bars: 5' or 3' untranslated regions; thin horizontal lines connect gene models). The shaded box highlights an arbitrarily chosen cluster spanning approximately 100 kbp.

Figure 13:
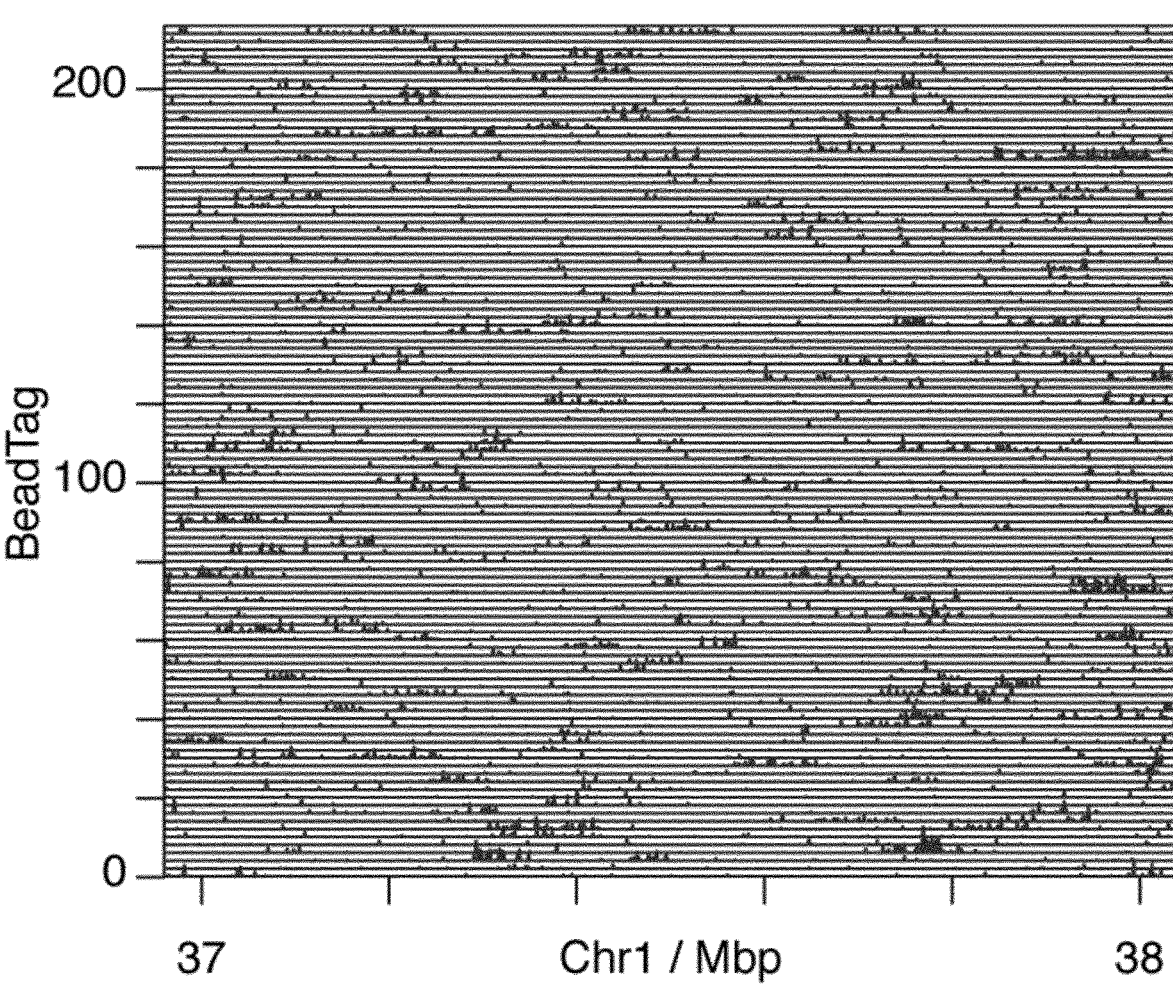

FIG. 13 shows the summarized location of 208 beadTags in a 1 Mbp region of Chr1: 37-38 Mbp. Within each row the height of the bars (drawn at 10 kbp resolution) show the number of reads corresponding to a given beadTag. The appearance of islands or mounts indicates the co-barcoding of DNA fragments which may have originated from the same starting DNA molecule.

Figure 14:
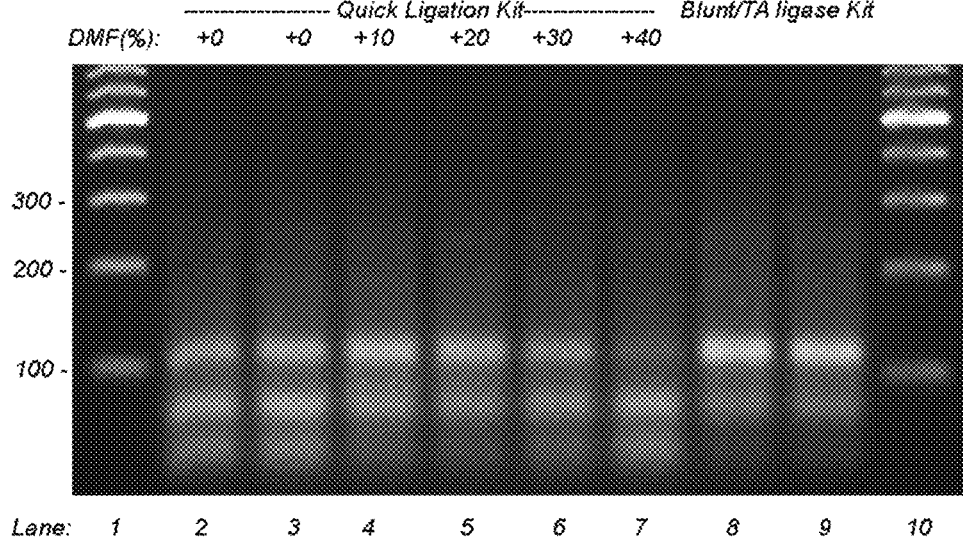

FIG. 14 shows the optimization experiments to determine the conditions for successful ligation of duplexes with only an 1 nt overhang. Lanes 1 and 10 show the standard DNA size markers, and Lanes 2-7 show the results from using Quick Ligase with N,N-dimethylformamide (DMF) additive at varying percentages (0, 10, 20, 30 and 40%). Lanes 8 and 9 show the results in replicate from using the Blunt/TA ligase kit.

Figure 15:
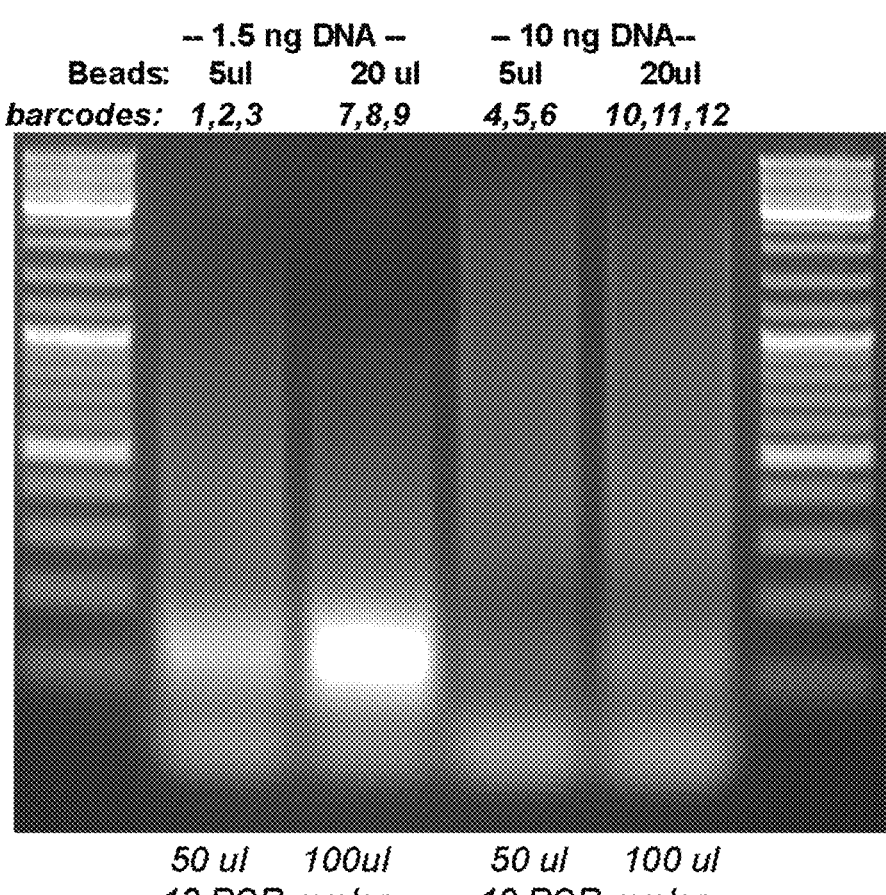

FIG. 15 shows the results from generating a sequencing library using haplotagging beads featuring up to 85 million combinations. Lane 1 shows the standard DNA size marker. Lanes 2-5 show the PCR amplified library from haplotagged DNA with input DNA of 1.5 ng (Lanes 2 and 3) and 10 ng (Lanes 4 and 5). In each case, the amount of input beads was also varied between 5 μl (Lanes 2 and 4) and 20 μl (Lanes 3 and 5). The thick black bar on the right indicates the preferred range of DNA fragments for sequencing. The PCR amplified genomic libraries are shown in the gel to evaluate the success and insertion frequency of tagmentation.

Figure 16:
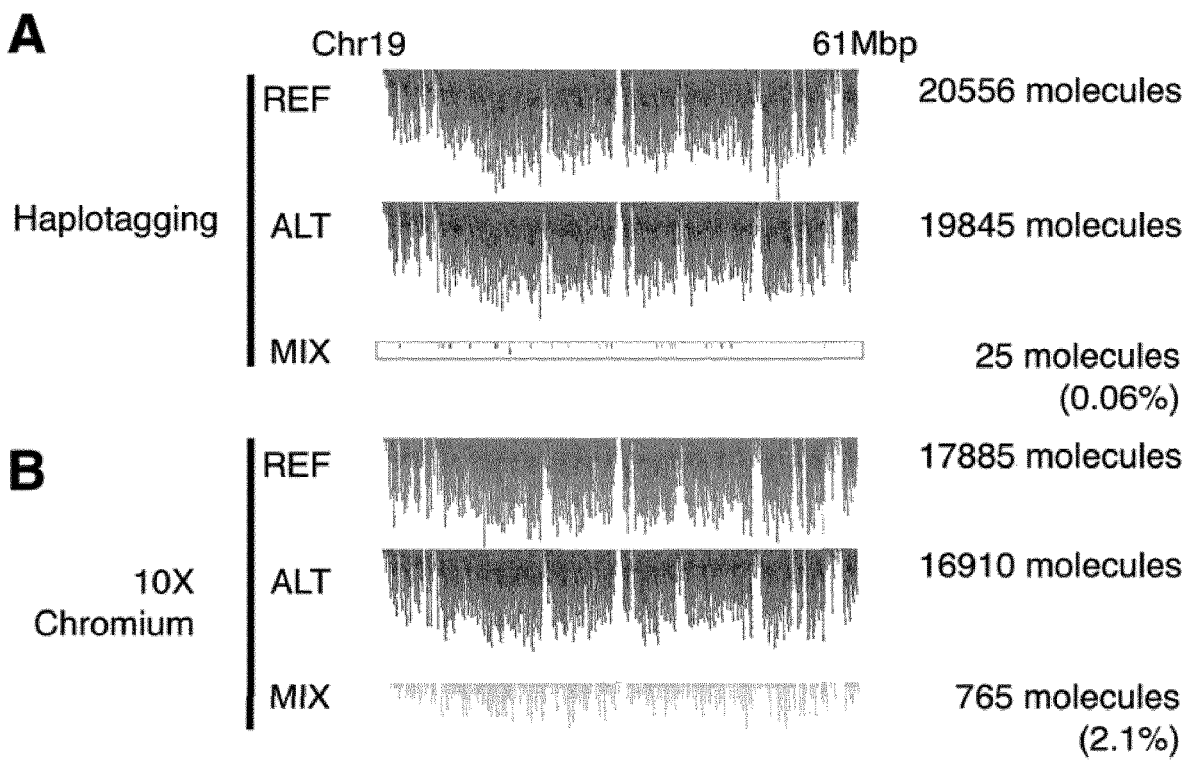

FIG. 16 shows in Panel A the data analysis results from having assigned beadTags to the two haplotypes corresponding to the reference ("Haplotype 0/REF") or the alternative ("Haplotype 1/ALT") alleles. The small remainders of bead-Tags that cannot be assigned to either Haplotypes 0 or 1 were assigned into "Haplotype MIX" near the bottom of the figure. For clarity, only the data from Chr19 is shown. The number of molecules plotted are shown on the right, along with a percentage to show the very low (0.06%) of Haplotype MIX molecules generated from haplotagging. Panel B of FIG. 16 shows data for the same HMW DNA template material but generated by using the 10× Chromium platform. This shows a clear side-by-side comparison between haplotagging and commercial linked read sequencing results. The fluctuation in molecules reflects the variation in the density of strain diagnostic positions along a chromosome, such that there are regions with fewer phase informative SNPs, and as a result, lower number of molecules. Another key difference between 10× Chromium and haplotagging is that there are substantially more molecules assigned into "MIX" class. Because these were prepared from identical template DNA, the lower MIX molecule class in haplotagging suggests that there is a lower rate of barcode collision.

Figure 17:
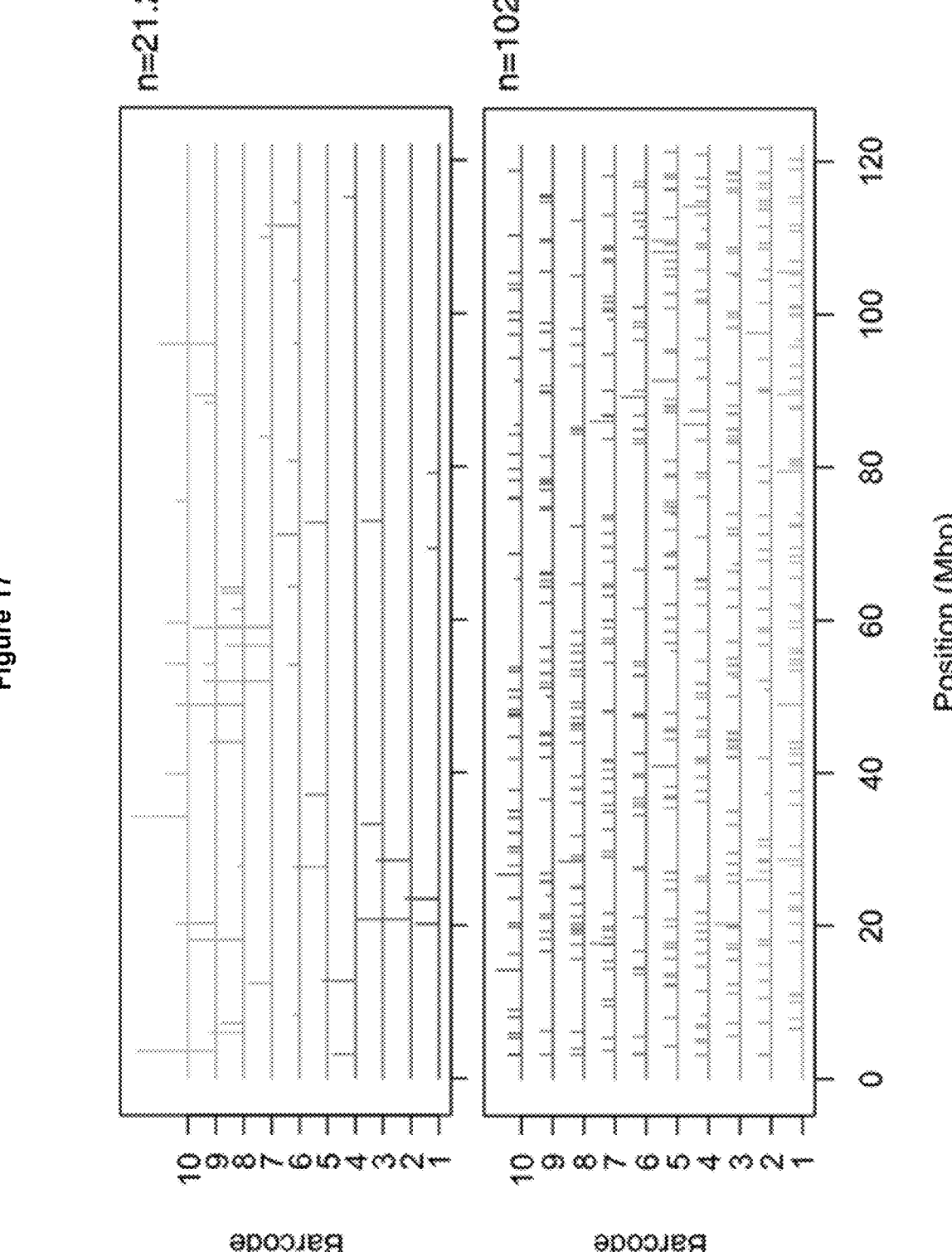

FIG. 17 shows the quantification of barcode frequency and a visual representation of barcode collision. In the top panel, the 10 most common beadTags on Chromosome 11 from a set of 21.2 million barcode haplotagged sequences are shown. In the bottom panel, the 10 most common beadTags from a set of 1024 barcodes from Example 6 are shown. The X-axis of each panel shows the chromosome position from 0 to approximately 120 Mbp along Chromosome 11. The Y-axis shows the frequency of each beadTag in a stacked format for the 10 barcodes.

FIG. 18 shows the conceptualization and the results from the exonuclease clean-up procedure described as Step 3 in FIG. 4. FIG. 18A shows the different type of primers and oligonucleotides and how they may be digested first by lambda exonuclease (sectors labelled with "λ"), followed by exonuclease I (sectors labelled with "Ex 1"). Digested DNA strands and phosphorus modifications are shown as dashed lines and symbols. Overhangs are drawn as "A" and "T" letters. DNA substrate resistant to digestion is shown as sectors with blocked access (crosses across sectors). FIG. 18B shows the gel electrophoresis results from direct in vitro digestion of duplexes A1 and C1. Lanes 1 and 8 show standard DNA size markers, and Lanes 2-7 show the different digestion conditions with no enzyme, lambda exonuclease only or both lambda and exonuclease I added. FIG. 18C shows the gel electrophoresis results from PCR amplified sequencing libraries after the clean-up reaction. Lanes 1 and 6 show standard DNA size markers, and Lanes 2-5 show the amplified library DNA with clean-up performed with lambda exonuclease, exonuclease I, both exonucleases or a no exonuclease control. The PCR amplified genomic libraries are shown in the gel to evaluate the success and insertion frequency of tagmentation.

FIG. 19 depicts in panel A schematically the configuration of a solid support (here exemplified as bead) as comprised in the mixture of solid supports according to the present invention. This schematic illustration should not be construed limiting and should merely visualize the different features of the solid supports of the claimed mixture. In the illustrated configuration each of the barcode sequences B1 and B2 comprises two barcode segments. As mentioned elsewhere herein and as defined in the claims, each of the barcode sequences may have up to 4 barcode segments. In the exemplified configuration also linker sequences between the barcode segments are shown (L1 for barcode B1 and L2 for the barcode B2). The length of this linker sequences is preferably two or less, even more preferably 1 nucleotide. The linkers L1 and L2 may also be absent, i.e. the barcode segments may be directly linked. ME stands for a minimum transposase Tn5 binding site. In principle binding to the transposase at this end of the transposons may also be mediated by different means, e.g. by having a single stranded section hybridizing with a reverse complementary sequence attached to a transposase bound transposon sequence. In principle, also a transposase other than Tn5 may be employed. Thus, also corresponding minimal transposon sequences may be used instead of ME.

Panel B shows a zoom view of the barcode sequences B1 and B2. It further shows that for generating barcode diversity, the nucleic acid sequence of each of the barcode segments is selected from a predefined set of nucleic acid sequences comprising a defined number of sequences, defined as $x_1$, $x_2$ and $k_1$, $k_2$, respectively. Of course the same applies to further segments if more than two segments are employed per barcode sequence. The length of each barcode sequence is preferably selected from 4 to 9 nucleotides. Even though the barcodes are depicted with equal length, the different barcode sequences can be also different in length. It is indicated in panel B that in each set of nucleic acid sequences the sequences differ at least in two nucleotide positions. This is crucial to allow error detection and correction. To improve error correction further the nucleic acid sequences in each predefined set of nucleic acid sequences may differ in at least 3 of the nucleic acid positions.

Figure 20:
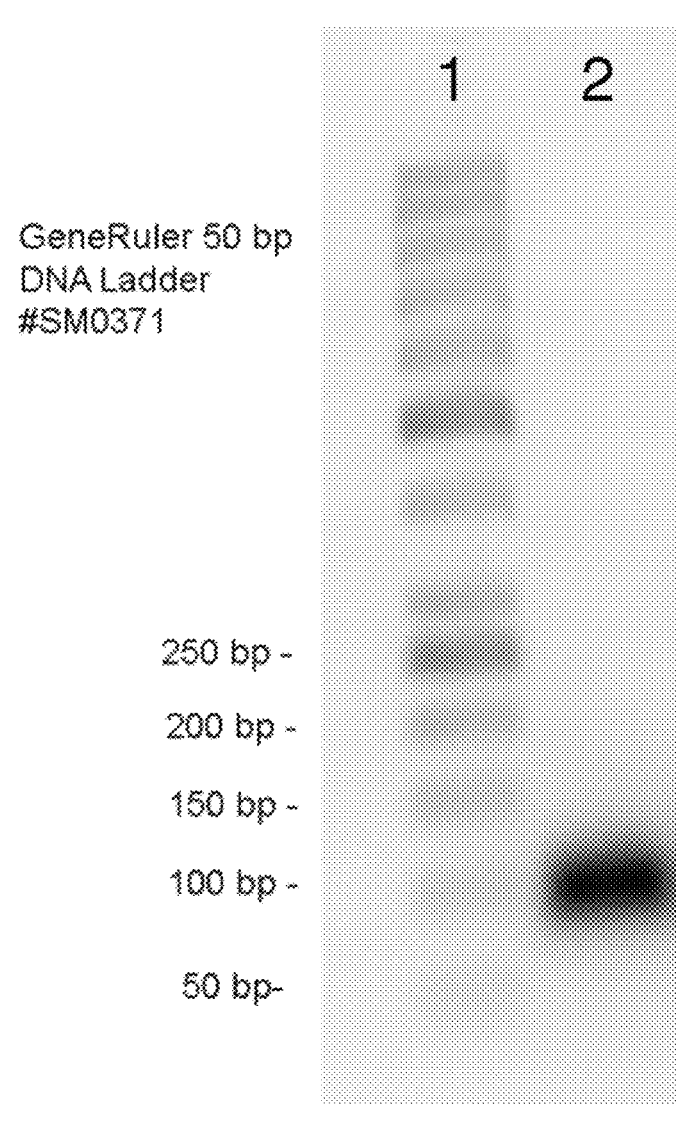

FIG. 20 shows an electrophoresis gel for inspection of successful PCR amplification across the assembled barcode segments without linker sequence. Lane 1 shows the GeneRuler 50 bp DNA ladder. Lane 2 shows the amplified PCR product. Unamplified linkers should be attached to the gel, and the A, B and C duplexes are all smaller than 50 bp in size. The strong band suggests consistent success in barcode segments assembly.

Figure 21:
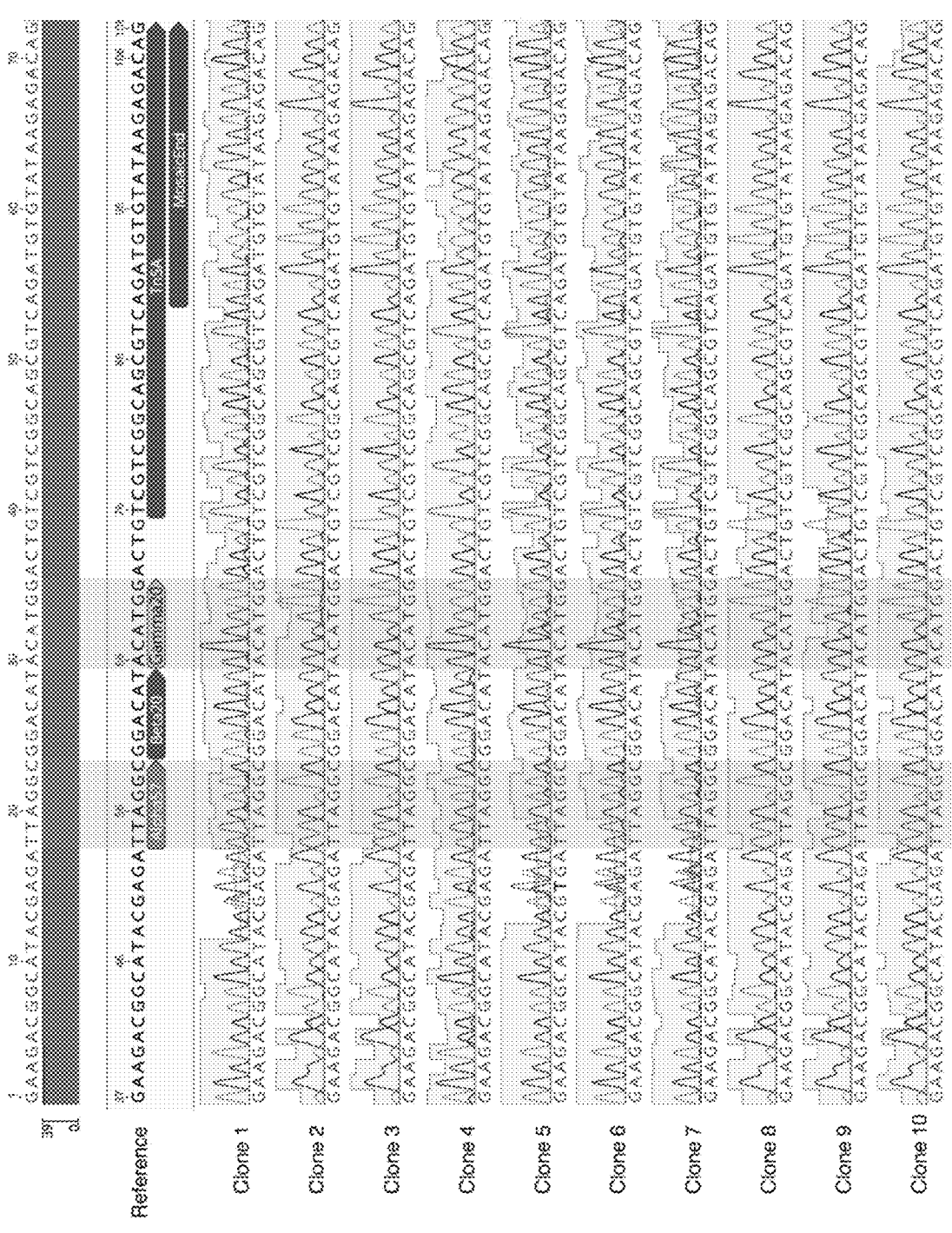

FIG. 21 depicts an electropherogram showing that multiple clones gave barcode segments (indicated by arrow symbols above the sequence traces; For clarity barcode segments Alpha57 and Gamma20 are shaded). Sequencing of a high number of bacterial clones showed that concatenating barcode segments without linker sequences can be achieved efficiently. Specifically, electropherogram traces from Sanger capillary sequencing are shown to allow detailed examination of individually assembled barcode segments. The expected sequence is shown at the top in sequence alphabets A, C, T and G. The results for ten clones are shown here, with the sequencing traces and the associated base call shown as sequences underneath the traces. The shaded segments correspond to the alpha, beta and gamma segments, and show that the barcode assembly was perfect for these clones. Overall the results show high consistently, as shown by the "coverage graph" above and gave a perfectly matching consensus sequence (top sequence).

FIG. 22 shows schematically the steps of an exemplary assembly process of linker-less (also referred to herein as "linker-free") adapters/transposons. The Figure shows the process for the assembly of one adapter/transposon. A second transposon/adapter may be generated by the same steps. The first part shows the preferred final configuration following linker-less assembly of the barcode segments. A bead, such as an M-280 streptavidin-coated paramagnetic Dynabead, is preferably used as a solid support (1) to the Tn5 transposons, which is attached through binding with binding moiety, such as a biotinylated moiety (2). Extending from the biotin moiety is an oligonucleotide A, connected by flexible poly-T 34 nt long linkers (4). The main Tn5 heteroadapters are shown as stylized arrows pointing from the 5' to 3' direction. They are mostly single-stranded and comprise or consist of the following key sections from 3' to 5': P7 capture sequence SEQ ID NO: 4 (fragment, from position 5 to 24), an i7 index segment, itself consisting of barcode segment "A" (6 nt), barcode segment "B" (6 nt) and (optionally) a barcode segment "C" (6 nt), followed by a Tn5A transposon sequence, which may correspond to the sequence Tn5ME-A SEQ ID NO: 9 in the sequence listing. This adapter can be brought into a "loaded Tn5 transposome" complex by binding to a Tn5 transposase (5). The loaded Tn5 transposome, in the presence of $Mg^{2+}$ ions and target substrate, can transpose and insert its transfer strand sequences into target DNA molecules. This is the enzymatic means by which target DNA molecules can be tagmented and made into sequencing compatible fragments flanked by adapter sequences.

In a first step of the assembly of a linker-less adapter, the Universal_anchor_P7 primer (SEQ ID NO: 1993) is attached to the bead via streptavidin-biotin binding on the 3' end of the Universal_anchor_P7 primer.

In a second step, the first branched oligonucleotide comprising of the first "alpha" segment (e.g., the duplex Alpha57 formed by annealing the primers AlphaFor57 with AlphaRev57, SEQ ID NOs: 1994 and 1995) is annealed with the Universal_anchor_P7 primer and ligated. Following ligation, the short, reverse complement strand is cut with a Type IIS restriction enzyme, e.g., MlyI and removed through the use of exonuclease III. The next panel of the figure shows the expected product with a restored 5' phosphorylation end following cleavage.

In a third step, the second branched oligonucleotide comprising of the second "beta" segment (e.g., the duplex Beta20 formed by annealing the primers BetaFor20 with BetaRev20, SEQ ID NOs: 1996 and 1997) is annealed with the first alpha segment. The annealing is mediated by approximately 10 bp of universal anchor segment and universal base pairing through a section of 6 inosine nucleotides, labelled as "(I)6", giving a total of 16 annealed basepairs. Following ligation, the short, reverse complement strand is cut with a Type IIS restriction enzyme, e.g., MlyI and removed through the use of exonuclease III. The next panel of the figure shows the expected product with a restored 5' phosphorylation end following cleavage.

In a fourth step, a third branched oligonucleotide comprising of the third "gamma" segment (e.g., the duplex Gamma20 formed by annealing the primers GammaFor20 with GammaRev20, SEQ ID NOs: 1998 and 1999) is annealed with the first two alpha and beta segments. The annealing is mediated by approximately 10 bp of universal anchor segment and universal base pairing through a section of 12 inosine nucleotides, labelled as "(I)12", giving a total of 22 annealed basepairs. Following ligation, the short, reverse complement strand is removed through the use of exonuclease III.

A last panel shows the final product with an exemplary loaded Tn5 transposome. This is the final assembled adapter. For clarity only a single adapter is shown on the bead. In practice the bead should be coated with a plurality of identical adapters. A second adapter/transposon may be generated the same manner so that a bead is covered with multiple copies of a solid-support specific set of two transposons.

FIG. 23 shows schematically the steps of an exemplary assembly process of linker-free adapters/transposons. The Figure shows the process for the assembly of one adapter/transposon. A second transposon/adapter may be generated by the same steps. The first part shows the preferred final configuration following linker-less assembly of the barcode segments. A bead, such as a M-280 streptavidin-coated paramagnetic Dynabead, is preferably used as a solid support (1) to the Tn5 transposons, which is attached through binding with binding moiety, such as a biotinylated moiety (2). Extending from the biotin moiety is an oligonucleotide A, connected by flexible poly-T 35 nt long linkers (4). The main Tn5 heteroadapters are shown as stylized arrows pointing from the 5' to 3' direction. They are mostly single-stranded and comprise or consist of the following key sections from 5' to 3': P7 capture sequence SEQ ID NO: 4 (fragment, from position 5 to 24), an i7 index segment, itself consisting of barcode segment "A" (6 nt), barcode segment "B" (6 nt) and (optionally) a barcode segment "C" (6 nt), followed by a Tn5B transposon sequence, which may correspond to the sequence Tn5ME-B SEQ ID NO: 10 in the sequence listing. This adapter can be brought into a "loaded Tn5 transposome" complex by binding to a Tn5 transposase (5). The loaded Tn5 transposome, in the presence of $Mg^{2+}$ ions and target substrate, can transpose and insert its transfer strand sequences into target DNA molecules. This is the enzymatic means by which target DNA molecules can be tagmented and made into sequencing compatible fragments flanked by adapter sequences.

In a first step of the assembly of a linker-free adapter, the Universal_anchor_P7 primer (SEQ ID NO: 2003), annealed to the first branched oligonucleotide comprising of the first "alpha" segment (e.g., the duplex A5 formed by annealing the primers AFor_5_CAGGAA with the Universal_Attachment and Universal_dI6, SEQ ID NOs: 2007, 2003 and 2004), is attached to the bead via streptavidin-biotin binding on the 5' end of the Universal_anchor_P7 primer. In a second step, the "alpha" segment is ligated to the universal anchor primer. Following ligation, the short, reverse complement strand is cut with a Type IIS restriction enzyme, e.g., SapI and removed through the use of A exonuclease. The next panel of the figure shows the expected product following cleavage.

In a third step, the second branched oligonucleotide comprising of the second "beta" segment (e.g., the duplex C6 formed by annealing the primers BFor_6_GAAACC with Universal_dI12, SEQ ID NOs: 2019 and 2005) is annealed with the first alpha segment. The annealing is mediated by approximately 10 bp of universal anchor segment and universal base pairing through a section of 6 inosine nucleotides, labelled as "(1) 6", giving a total of 16 annealed basepairs. Following ligation, the short, reverse complement strand is cut with a Type IIS restriction enzyme, e.g., SapI and removed through the use of A exonuclease. The next panel of the figure shows the expected product following cleavage.

In a fourth step, a third branched oligonucleotide comprising of the third "gamma" segment (e.g., the duplex D5 formed by annealing the primers CFor_5_AACAGG with Universal_dI18_Tn5B, SEQ ID NOs: 2032 and 2006) is annealed with the first two alpha and beta segments. The annealing is mediated by approximately 10 bp of universal anchor segment and universal base pairing through a section of 12 inosine nucleotides, labelled as "(I)12", giving a total of 22 annealed basepairs. Following ligation, the short, reverse complement strand is removed through the use of A exonuclease.

A last panel shows the final product with an exemplary loaded Tn5 transposome. This is the final assembled adapter. For clarity only a single adapter is shown on the bead. In practice the bead should be coated with a plurality of identical adapters. A second adapter/transposon may be generated the same manner so that a bead is covered with multiple copies of a solid-support specific set of two transposons.

Figure 24:
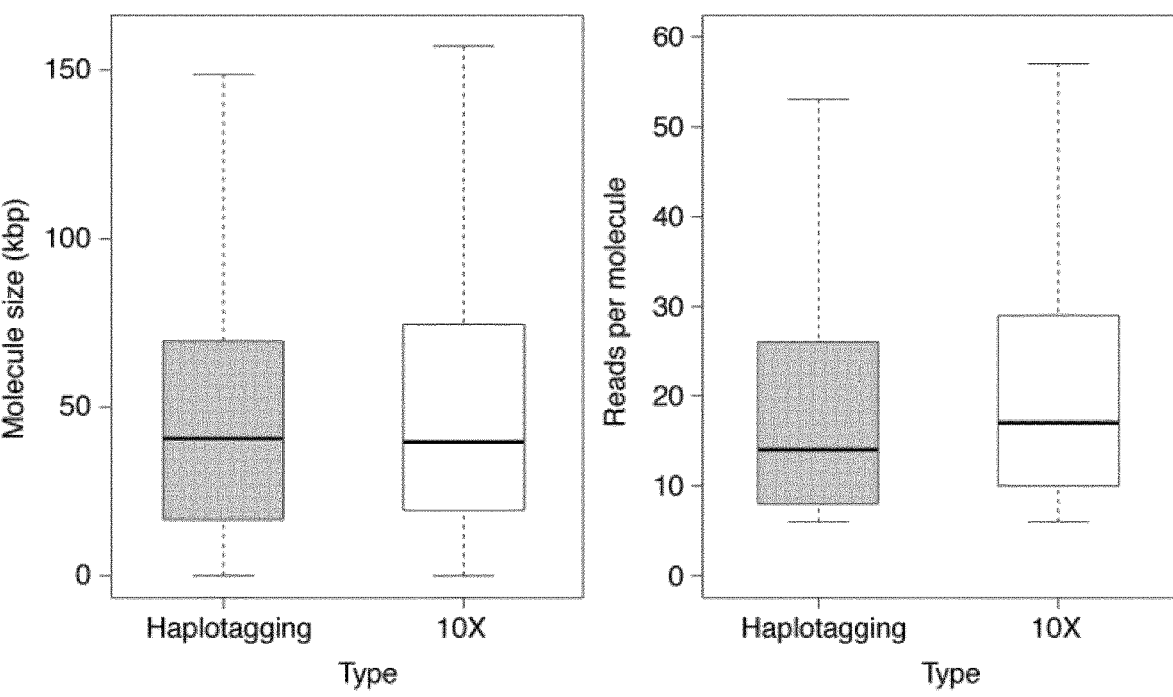

FIG. 24 shows the summary statistics generated from a single lane of sequencing on an Illumina HiSeq3000® (haplotagging, sequence throughput approximately 75 Gbp) or HiSeq XTen (10×, sequence throughput approximately 105 Gbp) instrument. The main evaluation criteria for linked read sequencing is the size of the molecules (left) and the number of reads sharing the same barcode in each molecule (right). Boxplots are shown to indicate the median (thick line) for haplotagging (40.6 kbp) and 10× Chromium (39.7 kbp), with the box spanning from the 25th quantile to the 75th quantile. For clarity extreme outlier points are not shown. There are also a comparable number of reads per molecule under haplotagging (median: 14 reads) and 10× Chromium (median: 17 reads).

Figure 25:
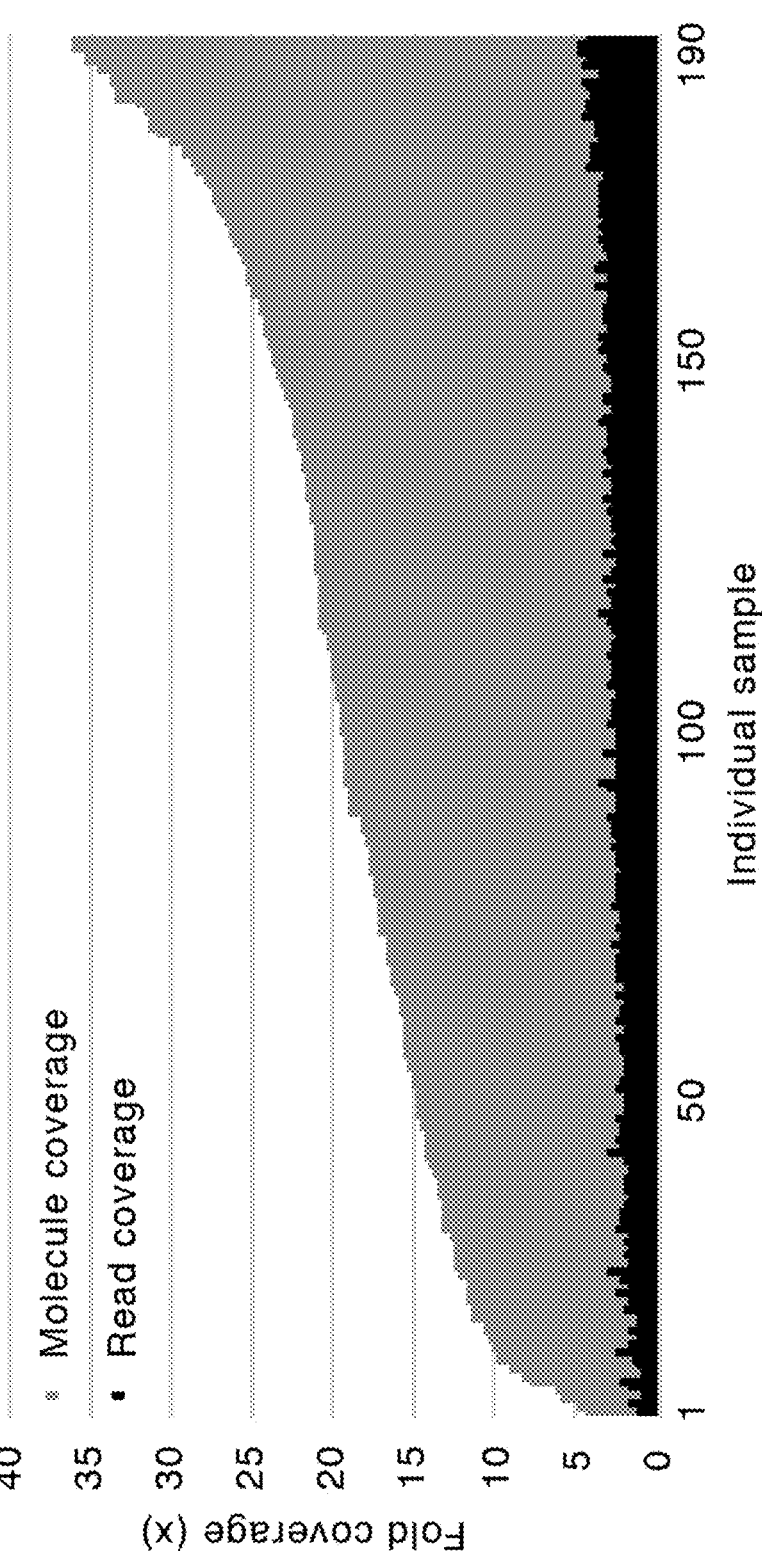

FIG. 25 shows sample coverage estimations from large sets of haplotagged butterfly samples. Sequencing coverage are shown as read-coverage (number of base pairs directly overlapped by a sequencing read, black) and as molecule coverage (number of base pairs spanned by a set of linked reads sharing the same beadTag, grey), respectively. The median read coverage was 2.72×, compared to the median molecule coverage of 19.40×.

Figure 26:
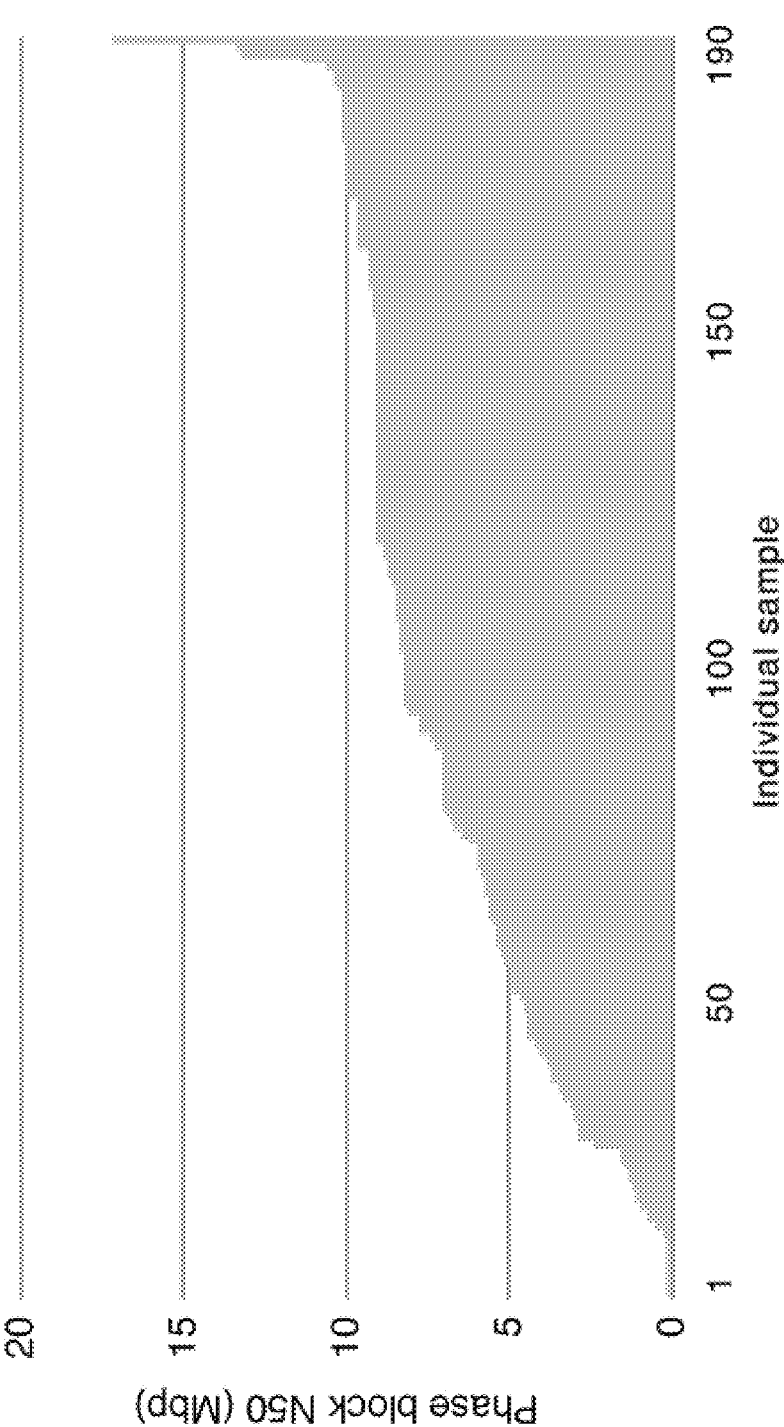

FIG. 26 shows phase block N50 estimations from large sets of haplotagged butterfly samples. The median read coverage was 8.26 Mbp.

Figure 27:
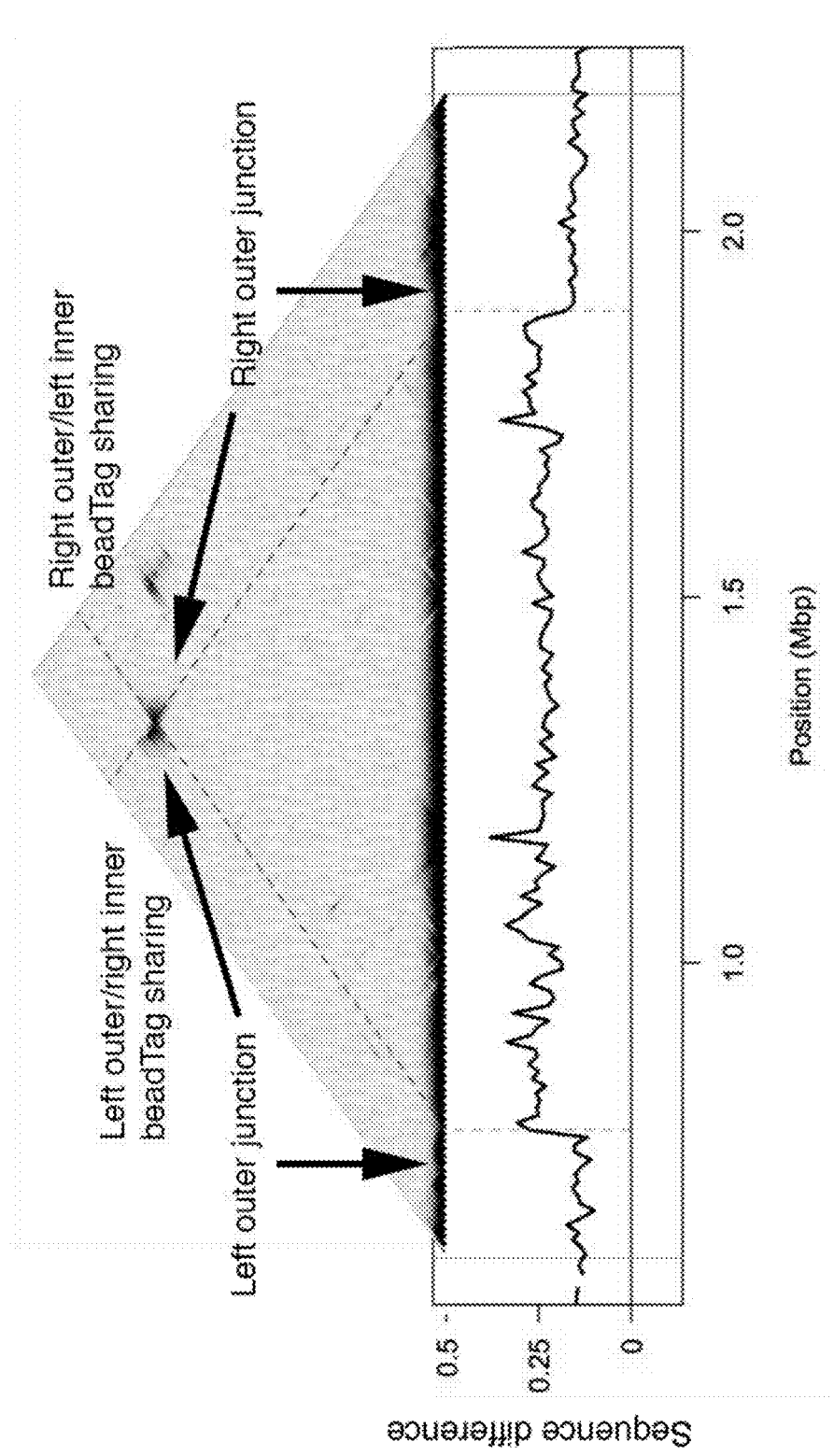

FIG. 27 shows a chromosome inversion that was detected from *Heliconius erato* butterfly samples. Top: A heatmap (shown as a triangular matrix) shows the extent of beadTag sharing between any two 10 kbp windows along chromosome 2. Along the long bottom edge of this matrix, dark colours indicate that there were many shared barcodes between adjacent 10 kbp windows and thus shows support for the sequence order in the genome assembly. Conversely, between windows that were further apart, there were generally very few shared beadTags between any two windows, thus giving the generally light colouring in the triangular heatmap. There was a set of windows that were very far apart (indicated by the dotted lines) that shared a large number of barcodes (intersection between the dotted lines forming an "X" pattern). Specifically, these were windows to the left of the left junction ("left outer junction") that showed strong sharing of beadTags with windows to the left of the right junction ("right inner junction"), and a similar pattern between the left inner/right outer junctions. The most consistent interpretation here was that the sequence segment between positions 0.75 Mbp and 1.87 Mbp have been inverted in some butterfly samples. Bottom: A plot showing a pairwise DNA difference between highland and lowland *H. erato* butterfly populations. This difference scales from 0 (no difference) to 1 (complete differences). There was a region of high difference between these two butterfly populations detected (shown in the shape of a plateau), with the left and right edges corresponding to the detected junctions of the inversion using the pattern of beadTag sharing. This further supported the presence of an inversion, which may prevent recombination in individuals heterozygous for the two inversion forms and thus, maintain DNA differences in natural populations.

The present invention is further illustrated by the following non-limiting Examples.

EXAMPLE 1—ESTABLISHING ON-BEAD TAGMENTATION

The efficiency and feasibility of tagmentation on solid surfaces were established by attaching assembled Tn5 transposomes onto the surfaces of microbeads by means of streptavidin-biotin binding prior to tagmentation. The suitability of two types of beads with diameters of 2.8 μm (M-280 Dynabeads) and 1 μm (C1 beads) were evaluated. For each type of bead, 4 μl of beads were incubated for 10 minutes with pre-assembled Tn5 transposomes, in which the duplexes consist of biotinylated Tn5ME-A SEQ ID NO: 9 with Tn5MErev SEQ ID NO: 11; and biotinylated Tn5ME-B SEQ ID NO: 10 with Tn5MErev). Tn5 transposase expression and purification was performed as described in Lazzarano et al., *PNAS* 2018, 115 (14) 3680-3685, which is incorporated herein by reference. An activity unit (U) of Tn5 was functionally defined as the amount of Tn5 protein that can tagment 10 ng of target genomic DNA to a range of 300-600 bp. Tn5 transposomes (2.5 U/μl) of varying volumes (0.125, 0.25, 0.5, 1, 2 and 4 μl) were attached onto 4 μl of M-280 and C1 beads. Tagmentation efficiency was evaluated by incubating the transposome-coated beads with 10 ng of target genomic DNA from a mouse (BL6) for 10 min at 55° C. The tagmented target DNA was amplified with the primers TruSeq-F SEQ ID NO: 11 and TruSeq-R SEQ ID NO: 13 with Q5 polymerase (NEB, M0491) according to manufacturer's instructions and the following PCR program: 5 min at 72° C., 30 sec 98° C. and 12 cycles of: 98° C. for 15 sec, 65° C. for 20 sec and 72° C. for 60 sec. The amplified products were visualized on a 1.5% agarose gel that is shown in FIG. 5. The results showed that the average tagmented DNA fragment size decreases as concentration of Tn5 increases, with the most DNA recovered between 300-600 bp at Tn5 input volumes of 0.25 µl and 0.5 µl (corresponding to 0.625 and 1.25 U). In contrast to the hydrophobic 2.8 µm M-280 beads, less tagmented products were amplified from the hydrophilic C1 beads of 1.0 µm diameter, with the highest concentration of tagmented DNA found at 0.125 µl of Tn5. Due to the superior features in on-bead tagmentation the M-280 beads were employed for the further experiments depicted in Examples 3 to 12. However, it is expected that also hydrophobic beads when increasing the incubation time significantly will result in sufficient tagmentation.

EXAMPLE 2—DETERMINATION OF OPTIMAL HETERODIMERIC TRANSPOSOME COMPLEX CONCENTRATION FOR PREPARING DNA SEQUENCING LIBRARY

Tn5 transposomes were assembled in-solution as described in Example 1. The optimal amount of input transposome complex to be attached on the bead was varied from 0.19, 0.375, 0.75, 1.5, 3 and 6 µl. Target genomic DNA was tagmented by incubating beads with the listed amount of Tn5 transposomes as described in Example 1. The results are shown in FIG. 6. The size ranges of the resulting DNA fragments were evaluated. The results show that the optimal input Tn5 amount was 0.375 µl for 4 µl of M-280 beads.

EXAMPLE 3—ESTABLISHMENT OF FEASIBILITY OF ON-BEAD ASSEMBLY OF TN5 TRANSPOSOME AND THE OPTIMAL CONCENTRATION THEREOF

Tagmentation efficiency and fragment sizes from direct on-bead assembly of Tn5 transposomes were evaluated by varying the concentration of heteroadapter duplexes (transposon duplexes) on beads. In this example, 2, 4, 6 and 8 µl of complete, biotinylated transposon duplexes (at 0.1 µM concentration of duplexes following annealing of primers i7biot_CGTaaGCT-complete (SEQ ID NO: 15), i5biot_TAGccATC-complete (SEQ ID NO: 16) and Tn5MErev (SEQ ID NO: 11) were added to 4 µl of M-280 beads. Tn5 transposomes were assembled directly onto the beads by adding 0.125 µl and 0.375 µl of Tn5 (2.5 U/µl) and incubating overnight at 4° C. with mixing on a tube rotator at 10 r.p.m. Tagmentation of target DNA was performed as described in Example 1. The tagmented DNA was amplified from the beads as described in Example 1. The sizes of the amplified DNA fragments were evaluated by electrophoresis on a 1.5% agarose gel and shown in FIG. 7. The data shows a dependency between tagmented DNA sizes and the concentration of Tn5 transposome duplexes. At both 0.125 µl and 0.375 µl of Tn5 transposase input amount, there is a dosage-dependent decrease in tagmented DNA fragment sizes. The highest concentration of DNA between 300-600 bp was found to correspond to an input amount of 8 µl of complete transposon duplexes and 0.375 µl of input Tn5 transposase.

EXAMPLE 4—ESTABLISHING THE REQUIREMENT OF MINIMIZING THE DOUBLE-STRANDED SEGMENTS OF THE TN5 TRANSPOSON DUPLEXES

The efficiency of bead-attached Tn5 transposomes in generating sequencing libraries were evaluated. First, 4 µl of 2.8 µm beads were coated with full transposon duplexes in amounts varying from 2, 4, 6, 8, 10 and 12 µl at 0.1 µM concentration. In all conditions, 0.25 µl of Tn5 transposase were incubated overnight at 4° C. with the beads with mixing on a tube rotator at 10 r.p.m, and tagmentation efficiency were evaluated by incubating with 10 ng of genomic DNA at 55° C. for 10 minutes. Following incubation, PCR amplification with primers SEQ ID NO: 13 and SEQ ID NO: 14 for 10 cycles were performed. The size of the amplified DNA was visualized on a gel and shown in the left panel of FIG. 8. The data shows very strong bands at 150 bp under all concentrations of Tn5 transposons duplexes, with a minor fraction of larger DNA of variable length. Close examination of these larger DNA fragments shows a dose-dependent concentration effect of smaller DNA fragments with increasing duplex concentration, consistent with more efficient tagmentation. The strong 150 bp band is likely due to Tn5 transposition onto other available attached double-stranded adapter duplexes on the bead surface ("self-tagmentation"). The inhibition of self-tagmentation was evaluated by adding a chemical melting or denaturing step following full assembly of the transposons, with subsequent addition of the oligonucleotide (Tn5MErev SEQ ID NO: 11), which corresponds to the minimal duplex required for Tn5 transposome assembly and transposition, i.e. for formation of a double stranded transposome recognition sequence. The right panel of FIG. 8 shows the resulting tagmentation, which has largely minimized the self-tagmentation 150 bp product. Instead it shows tagmented DNA fragments of variable size, ranging from approximately 200 to 1200 bp, and fragment sizes were evaluated by varying the concentration of heterotransposon duplexes on beads. These results show that minimizing the length of double-stranded segments within the transposons heterodimers on the beads has the advantage of avoiding self-tagmentation of the transposon sequences, which can result in a sequencing library consisting of almost entirely adapter sequences with little utility.

EXAMPLE 5—QUANTIFICATION OF CO-BARCODING OF ON-BEAD DNA TAGMENTED FRAGMENTS

The ability to reconstruct the contiguity information of the input target DNA molecule depends on the exclusive tagmentation of a target DNA molecule by the Tn5 transposomes found on the same bead. Beads were assembled with Tn5 heterodimer transposome complexes of four types: A1B1C1D1 by the transposon heteroadapters A1C1 (assembled from SEQ ID NOs: 17, 21 and 33, 41) and B1D1 (assembled from SEQ ID NO: 25, 29 and 49, 57), A2C2 (assembled from SEQ ID NOs: 18, 22 and 34, 42), B2D2 (assembled from SEQ ID NOs: 26, 30 and 50, 58), A3C3 (assembled from SEQ ID NOs: 19, 23 and 35, 43), B3D3 (assembled from SEQ ID NOs: 27, 31 and 51, 59) and A4C4 (assembled from SEQ ID NOs: 20, 24 and 36, 44) and B4D4 (assembled from SEQ ID NOs: 28, 32 and 52, 60). Genomic DNA was tagmented as described in Example 1. The efficiency of co-barcoding in a single tube was evaluated by quantitative PCR with barcode-specific primers (A1C1 SEQ ID NO: 65, A2C2 SEQ ID NO: 66, A3C3 SEQ ID NO: 67, A4C4 SEQ ID NO: 68; B1D1 SEQ ID NO: 69, B2D2 SEQ ID NO: 69, B3D3 SEQ ID NO: 71, B4D4 SEQ ID NO: 72). Continuous detection of PCR products was performed on a CFX384 Touch Real-Time PCR Detection System with SYBR™ Select Master Mix for CFX. The amount of amplified DNA was detected by fluorescence and normalized against the canonical A1C1-B1D1 combinations. Table 1 illustrates that a vast majority of target DNA were shown to be tagged by the Tn5 transposomes carrying the same barcode, suggesting that most of the tagmentation reactions occurred on the surface of a single bead. In this Example, frequent cross-barcode amplifications were expected due to the low diversity of barcodes, but it was evident that much of the tagmented DNA was flanked by the intended barcode combinations, i.e. the first barcode sequence and the second barcode sequence of a bead-specific transposon pair.

EXAMPLE 6—ESTABLISHMENT OF LINKED-READ SEQUENCING BY ILLUMINA® SEQUENCING

The feasibility of generating barcode segments A, B, C and D into the i5 and i7 positions of the Nextera adapter was evaluated with a restricted set of 1024 barcode combinations (with in total 4 A and B duplexes and 8 C and D duplexes, SEQ ID NO: 17 to 60). To make the double-stranded duplexes, 20 µl of each of the i7-biot-N701_TCG, i7-biot-N702_CTA, i7-biot-N703_TTC and i7-biot-N704_GCT (SEQ ID NOs: 17 to 20) (10 µM) were mixed with 22 µl of its corresponding 10 u M reverse complement oligonucle-otides (i7-Bot-N701_TCG-TT, i7-Bot-N702_CTA-TT, i7-Bot-N703_TTC-TT and i7-Bot-N704_GCT-TT, SEQ ID NOs: 21 to 24) and 5 µl of 10× Annealing buffer (500 mM NaCl, 100 mM Tris buffer, pH 8) in a 8-strip tube. Oligo-nucleotides were then annealed to form double-stranded duplexes with a 2 nt overhang. Annealing was performed by heating the mix to 95° C. and decreasing the temperature by 1° C. every minute until 40° C. 10 µl of these 5 µM A duplexes were then diluted 10× with 1× annealing buffer into a new 8-strip tube (working concentration of 0.5 µM). The same procedure was repeated for the forward oligonucle-otides (SEQ ID NO: 25 to 28, 33 to 40 and 49 to 56) with their corresponding reverse complement oligonucleotides (SEQ ID NO: 29 to 32, 41 to 48, 57 to 64). To attach the A duplexes, 10 µl of M-280 beads were pipetted into 4 0.2 ml tubes. With the tubes placed on the magnetic stand, the beads were washed twice with 50 µl of Streptavidin Binding Buffer (SBB buffer: 0.6 M NaCl, 20 mM Tris buffer pH 8, 0.5 mM EDTA, 0.1% Triton X-100), leaving the second 50 µl of SBB buffer in the tubes. After removing the tubes from the magnetic stand 4 µl of 0.5 µM A-duplex (A1-A4) were added in the tubes with a 10 µl multi-channel pipette, and immediately mixed to re-suspend the beads with 200 µl multi-channel pipette to ensure even binding of duplexes onto the surface of the beads. Tubes were then capped and incubated while mixing on a plate-rotator at 9 revolutions per minute (r.p.m.) at room temperature (r.t.; e.g., a tem-perature from 18 to 25° C.) for 30 minutes.

After the incubation the tubes were spun-down in a centrifuge for 10 seconds and placed on the magnetic stand. Supernatant was removed and replaced with 150 µl of fresh SBB buffer per tube; the tubes were then capped and mixed on a plate-rotator for 10 minutes at 9 r.p.m. This bead-washing step was repeated one more time.

After the removal of the second wash, 100 µl of SBB buffer was added to the first tube. Using a pipette and with the tubes away from the magnetic stand, beads in the first tube were re-suspended and transferred to tube 2 and the procedure was repeated until the fourth tube was reached. All the beads, now in a single tube and in 100 µl of SBB buffer, were then transferred into a clean 1.5 ml Eppendorf tube. To recover any left-over beads, the tubes were washed one more time using the same procedure using 100 µl of fresh SBB buffer in the first tube. The second wash was then pooled with the 100 µl already in the 1.5 ml Eppendorf tube. Volume was adjusted with SBB buffer to 400 µl. These duplex-A tagged beads were then slit into 4 new 0.2 ml tubes at 100 µl per tube. The leftover beads in the 1.5 ml Eppendorf tube were re-suspended in an extra 40 µl of SBB buffer and redistributed at 10 µl per tube.

The tubes were placed on the magnetic stand for 1 minute then removed from the stand. 4 µl of 0.5 µM B-duplex (B1-B4) were added to the wells with a 10 µl multi-channel pipette, and immediately mixed to re-suspend the beads with 200 µl multi-channel pipette to ensure even binding of duplexes onto the surface of the beads. The tubes were capped and incubated while mixing on a plate-rotator at 9 r.p.m at room temperature for 30 minutes. After the incu-bation the tubes were spun-down in a centrifuge for 10 seconds and the beads were washed 2×, pooled, and split equally into 8 clean 0.2 ml tubes.

The 8 tubes containing duplex-A&B-tagged beads were placed on the magnetic stand for 1 minute. Supernatant was removed and 4 µl of 0.5 µM C-duplex (C1-C8) were pipetted in each well. Next, 16 µl of 1× Quick Ligase Master Mix containing 0.5 µl of Quick Ligase was added per well. The tubes were capped, vortexed to re-suspend the beads, and incubated while mixing on a plate-rotator at 9 r.p.m. at room temperature for 15 minutes. After the incubation the tubes were spun-down in a centrifuge for 10 seconds and the beads were washed 2×, pooled and split equally into 8 clean 0.2 ml tubes, repeating the same procedure as described above.

The 8 tubes containing duplex-A&B&C-tagged beads were placed on the magnetic stand for 1 minute. Supernatant was removed and 4 µl of 0.5 µM duplex-D (D01-D8) were pipetted in each well. Next, 16 µl of 1× Quick Ligase Master Mix containing 0.5 µl of Quick Ligase was added per well. The tubes were capped, vortexed to resuspend the beads, and incubated while mixing on a plate-rotator at 9 r.p.m. at room temperature for 15 minutes. After the incubation the tubes were spun-down in a centrifuge for 30 seconds and the beads were washed 2×. Duplex-A&B&C&D-tagged beads from all 8 tubes (8×5 µl of original M-280 streptavidin beads) were pooled into a single 1.5 ml Eppendorf tube.

The pool was then subjected to chemical single-stranding to remove and replace the non-biotinylated strand with the universal Tn5MErev oligonucleotide (SEQ ID NO: 11). Beads were re-suspended in 150 µl of 0.15 M NaOH for 5 minutes at r.t., then placed on magnetic stand for 1 minute. Supernatant was removed and the beads were washed with 150 µl of WASH buffer (50 mM NaCl, 30 mM Tris pH=8, 0.1% Triton X-100) supplemented with 1 µM Tn5MErev oligonucleotide (SEQ ID NO: 11) and 0.1% BSA and mixed at 9 r.p.m. on a tube rotator for 5 minutes. On magnetic stand, supernatant was then removed and the chemical single-stranding step was repeated one more time. Bead pool was then assembled with the in-house expressed and purified 0.25 µl (0.625 U) of Tn5 transposase per each 5 µl of beads over 2 days on a tube rotator at 4° C. in 0.5 ml of dialysis/storage buffer (100 mM HEPES-KOH PH=7.2; 0.2 M NaCl, 0.2 mM EDTA, 0.2% Triton X-100, 20% glycerol). Assembled beads (40 µl of initial M-280 beads) were then washed twice with 1 ml of dialysis/storage buffer and stored in 200 µl of dialysis/storage buffer at 4° C. (5 µl of initial M-280 beads in 25 µl) until tagmentation.

To prepare haplotagging libraries that could be run as a single lane of HiSeq3000 run, 1.5 ng, 0.75 ng or 0 ng of high-molecular weight DNA (HMW DNA) from a (BL6× CAST) F1 hybrid mouse and 5 µl of the haplotagging beads were transferred into 4 tubes of a 8-tube-PCR-strip. The experimental design is shown in FIG. 9. In another 8-tube-PCR-strip, tagmentation mixture was prepared by adding in each tube 110 μl of H$_2$O, 10 μl, 5 μl or 2.5 μl of 0.15 ng/μl HMW DNA and 30 μl of 5×TAPS-Mg-DMF buffer (50 mM TAPS pH 8.5 with NaOH, 25 mM MgCl$_2$, 50% N,N-dimethylformamide). Next, while on a magnetic stand, storage buffer was removed from the beads and the HMW DNA-TAPS-Mg-DMF mixture was carefully transferred onto the beads with a wide orifice pipette tip. Samples were mixed by inverting the tubes approximately 10 times or until complete re-suspension of the beads. Samples were incubated at 55° C. for 10 minutes for tagmentation of the HMW DNA, then 15 μl of 4% SDS was added to each sample; samples were mixed by inverting the tubes and incubated at 55° C. for another 10 minutes to inactivate and strip Tn5 from DNA. Samples were then spun down for 30 seconds and placed on a magnetic stand. Supernatant was removed and beads were washed twice with WASH buffer (50 mM NaCl, 30 mM Tris pH=8, 0.1% Triton X-100) and left stand in the second wash buffer till the Q5 polymerase PCR mix was prepared and ready to be transferred to all samples. Q5 High-Fidelity DNA Polymerase was used to amplify the haplotagged DNA bound to the beads using 4 μl of 10 μM PCR primers, TruSeq-F SEQ ID NO: 13 and TruSeq-R SEQ ID NO: 14, in a 50 μl reaction according to manufacturer's instructions, with the following cycling conditions: 5 min at 72° C., 30 sec 98° C. and 13 cycles of: 98° C. for 15 sec, 65° C. for 20 sec and 72° C. for 60 sec. FIG. 10 shows the resulting distribution of library fragment sizes. It shows that immobilized Tn5 transposomes produces libraries of suitable sizes for sequencing; and with sufficient input of at least 0.75 ng, there was little dependence of fragment size distribution on input target DNA concentration.

Individual libraries were size selected using Ampure magnetic beads (#A63881, Beckman Coulter) for 300-600 bp fragment size. The resulting library was analyzed for its size distribution using a Bioanalyzer chip. FIG. 11 shows the estimated DNA concentration of the sequencing library over the range of up to 10 kbp.

An aliquot of 0.75 ng of the resulting library, i.e. an aliquot of the resulting library at a concentration of 0.75 ng/μl, was sequenced as a 2×150 cycle paired-end sequencing lane as a standard Nextera library on an Illumina HiSeq3000® instrument with 8 cycles each for the i7 and i5 indexing reads.

The sequencing run generated 668,563,412 reads and a total sequence throughput of 100.3 Gbp, of which 94.4% of reads passed filter, yielding 90.4 Gbp of sequence. These raw sequence reads were demultiplexed using a combination of standard Illumina® software and simple command-line searches for exact matches to the four segments of the barcodes, defined here as a "beadTag". In this Example the barcodes were already segmented but do not have error-correcting features. The reads were then placed against the reference mouse genome assembly mm10 using the publicly available software bwa v0.7.10-r789 (Li and Durbin, Bioinformatics 2010, 26 (5): 589-95) and processed using samtools v1.2 (Li et al., Bioinformatics 2009, 25 (16): 2078-9), marking and ignoring PCR and optical duplicate reads in subsequent analyses. The combined A, B, C and D segments of the index reads were parsed for exact matches to the 1024 combinations and assigned as "beadTags". The position of each beadTag was summarized in 10 kbp windows along the genome using the publicly available software bxtools, specifically its "tile" module. FIG. 12 shows a 4.5 Mbp region on Chr2 that contains several clusters of reads corresponding to specific beadTags A1C1 and A1C8.

The data shows that reads corresponding to each specific beadTag form tight clusters along the chromosome, indicating that single DNA molecules could be uniquely tagged by immobilized Tn5 transposomes on beads.

FIG. 13 shows the summarized counts of the first 208 beadTags in a 1 Mbp region at Chr1: 37-38 Mbp. This data reveals more broadly the pattern of unique tagging of molecules from many of the beads. However, it also shows a high number of individual reads scattered along the 1 Mbp window, indicating that 1024 barcodes did not represent sufficient diversity for unique tagging of a mix of molecules from genomic or metagenomic DNA from biological samples.

EXAMPLE 7—ESTABLISHMENT OF THE FEASIBILITY OF MINIMIZING THE OVERHANG FOR LIGATION BETWEEN BARCODE SEGMENTS TO 1 NT

Due to the current limits of a maximum of 25 indexing cycles in the sequencing recipe design and reagent amounts in standard Illumina® sequencing flow cell kits, the configuration supporting the highest barcode diversity would be achieved by partitioning a total of 25 indexing cycles into segments, each of which of 4 nt to up to 9 nt long, as shown in Table 2. For example, a 13 nt i5 index read can be split into segments of 6 nt+7 nt, yielding 23,630 combinations; alternatively, it can be 5 nt+8 nt, yielding 34,896 combinations. Combined with the costs of synthesizing the required oligonucleotide duplexes, then the slightly lower diversity in a 6 nt+7 nt barcode combination becomes favorable, because it only requires a total of 363 unique sets of duplexes, whereas 5 nt+8 nt would require nearly double the number of duplexes (775). This latter factor also has downstream effect on the amount of reagents used for the assembly and synthesis of beads. In general shorter barcode segments have also the advantage that the error rate in oligonucleotide synthesis is reduced.

Table 3 shows the complexity statistics for a set of 84 barcodes and the effect of adding 12 additional barcodes to make it up to 96, such that the entire split-and-pool assembly reaction can be performed on standard 96-well plate formats, with minimal effects on the possibility to detect or where possible, correct errors. The main statistics to describe barcode complexity is Hamming distance, which describes the number of edits required between a pair of barcodes with constant length. This is most applicable in the current application. The result shows that it is feasible to extend the set of barcodes to 96, i.e. 84 sequences differing in at least 3 nucleotide positions and 12 sequences differing in two nucleotide positions. With 96 barcodes per segment and a total of 4 segments or 24 nt plus 2-4 nt for overhangs, a set of barcodes with up to approximately 85 million combinations can be encoded among the beadTags.

Given the strict limit on the combined length of the i5 and i7 index reads (25 nt) under standard running conditions, the feasibility of efficient ligation with an 1 nt overhang was evaluated. In addition, to avoid having the higher costs associated with synthesizing multiple attaching biotinylated primer in order to vary the overhang for ligation, 5' overhangs on the short, complementary strand (instead of the more stable and common 3' overhang) were designed. FIG. 14 shows the results from testing varying concentrations of the additive DMF into the Quick Ligation kit and the use of the Blunt/TA ligase kit, followed by PCR as performed in Example 6. The combined signal of the strong band over 100 bp and a corresponding depletion of the smallest 30 bp band shows successful ligation near completion. The data shows that under most conditions, the Quick Ligase Kit was not able to perform ligation near completion between A and C duplexes with only an 1 nt 5' A/T overhang. In contrast, the Blunt/TA ligase kit is able to ligate the duplexes together near completion, showing that with using this enzyme it would be possible to assemble the beads as required by the design ligating sets of 96 duplexes with minimal overhangs. With this result the possible combinations of barcodes were extended to over 85 million with four sets of duplexes of 96 each.

EXAMPLE 8—DEMONSTRATION OF THE FEASIBILITY OF GENERATING ILLUMINA® NEXTERA STANDARD COMPATIBLE LIBRARIES THROUGH HAPLOTAGGING

Combining the conclusions from Examples 6 and 7, haplotagging beads based on sets of A, B, C and D duplexes of 96 each were assembled and loaded with Tn5 transposase. The set of oligonucleotides described in SEQ ID NO: 73 to 552, 937 to 1032, 1225 to 1320 and 1705 to 1800 were ordered from Integrated DNA Technologies, Inc.

To prepare the A duplexes, 20 µl of each of the AFor_1-96 oligonucleotides (10 µM, SEQ ID NO: 73 to 168) were mixed with 22 µl of its corresponding 10 µM reverse complement oligonucleotides (ARev_1-96 oligonucle-otides, SEQ ID NO: 457 to 552) and 5 µl of 10× Annealing buffer (500 mM NaCl, 100 mM Tris buffer, pH 8) in a 96-well plate.

Oligonucleotides were then annealed to form double stranded duplexes with an overhang.

Annealing was performed by heating the plate to 95° C. and decreasing the temperature by 1° C. every minute until 40° C. 10 µl of these 5 µM A-duplexes_1-96 were then 10× diluted with 1× annealing buffer into a new 96-well plate (working concentration of 0.5 µM).

The same procedure was repeated for BFor_1-96 (SEQ ID NO: 169 to 264), CFor_1-96 (SEQ ID NO: 1225 to 1320) and DFor_1-96 (SEQ ID NO: 1705 to 1800) oligonucle-otides with their corresponding reverse complement oligo-nucleotides BRev_1-96 (SEQ ID NO: 841 to 936), CRev_1-96 (SEQ ID NO: 265 to 360) and DRev_1-96 (SEQ ID NO: 361 to 456).

As solid supports, 5 µl of "Dynabeads™ M-280 Strepta-vidin magnetic beads" (#11205D, ThermoFisher Scientific®$^{Sigma}$) were pipetted per each well of a 96-well-plate. With a 96-well-plate placed on the magnetic stand, the beads were washed twice with 50 µl of Streptavidin Binding Buffer (SBB buffer: 0.6 M NaCl, 20 mM Tris buffer pH 8, 0.5 mM EDTA, 0.1% Triton X-100), leaving the second 50 µl of SBB buffer in the plate. After removing the plate from the magnetic stand 2 µl of 0.5 µM A-duplex (A1-A96) were added to the wells column-by-column with a 10 µl multi-channel pipette, and immediately mixed to re-suspend the beads with 200 µl multi-channel pipette to ensure even binding of duplexes onto the surface of the beads. Plate was then sealed and incubated while mixing on a plate-rotator at 9 revolutions per minute (r.p.m.) at room temperature for 30 minutes.

After the incubation plate was spun-down in a centrifuge for 30 seconds and placed on the magnetic stand. Superna-tant was removed and replaced with 150 µl of fresh SBB buffer per each well; plate was then sealed and mixed on a plate-rotator for 10 minutes at 9 r.p.m. This bead-washing step was repeated one more time.

After the removal of the second wash, 100 µl of SBB buffer was added to the 8 wells of the first column of the plate. Using a multi-channel pipette and with the plate away from the magnetic stand, beads in the first column were re-suspended and transferred to column 2 and the procedure was repeated until the end of the plate was reached (column 12). All the beads (in 8×100 µl of SBB buffer), now in the column 12, were then transferred into a clean 15 ml tube. To recover any left-over beads, the plate was washed one more time using the same procedure using 100 µl of fresh SBB buffer in the wells of the first column. The second wash (8×100 µl) was then pooled with the 800 µl already in the 15 ml tube. Volume was adjusted with SBB buffer to 5 ml. These duplexA-tagged beads were then slit into a new 96-well plate, at 50 µl per well. The leftover beads in the 15 ml tube were re-suspended in an extra 1 ml of SBB buffer and redistributed at 10 µl per well into the same plate. Duplex-B binding to the streptavidin magnetic beads (9216 combinations).

Plate was placed on the magnetic stand for 1 minute then removed from the stand. 2 µl of 0.5 µM B-duplex (B1-A96) were added to the wells with a 10 µl multi-channel pipette, and immediately mixed to re-suspend the beads with 200 µl multi-channel pipette to ensure even binding of duplexes onto the surface of the beads. Plate was then sealed and incubated while mixing on a plate-rotator at 9 r.p.m at room temperature for 30 minutes. After the incubation plate was spun-down in a centrifuge for 30 seconds and the beads were washed 2×, pooled and split into a new plate, repeating the same procedure done with duplexes-A1-96 from the previ-ous step.

Plate containing duplex-A&B-tagged beads was placed on the magnetic stand for 1 minute. Supernatant was removed and 7.5 µl of 0.5 µM duplex-C_1-96 were pipetted in each well. Next, 7.5 µl of 2× Blunt/TA Ligase Master Mix (M0367, New England BioLabs®) was added per well. Plate was then sealed, vortexed to re-suspend the beads, and incubated while mixing on a plate-rotator at 9 r.p.m. at room temperature for 15 minutes. After the incubation plate was spun-down in a centrifuge for 30 seconds and the beads were washed 2×, pooled and split into a new plate, repeating the same procedure as described above.

Plate containing duplex-A&B&C-tagged beads was placed on the magnetic stand for 1 minute. Supernatant was removed and 7.5 µl of 0.5 µM duplex-D_01-96 were pipetted in each well. Next, 7.5 µl of 2× Blunt/TA Ligase Master Mix (M0367, New England BioLabs®) was added per well. Plate was then sealed, vortexed to resuspend the beads, and incubated while mixing on a plate-rotator at 9 r.p.m. at room temperature for 15 minutes. After the incu-bation plate was spun-down in a centrifuge for 30 seconds and the beads were washed 2× and pooled into 4 separate pools of beads: Pool 1, beads from the columns 1-3; Pool 2, beads from the columns 4-6; Pool 3, beads from the columns 7-9; Pool 4, beads from the columns 10-12. Each pool contains beads carrying 21,233,664. of the 85 million pos-sible index combinations, thus, allowing 4 sample multi-plexing in a single lane of a HiSeq sequencing run. Each pool was then subjected to chemical single-stranding to remove and replace the nonbiotinylated strand with the universal Tn5MERev primer (SEQ ID NO: 11). Beads of each pool were re-suspended in 150 µl of 0.15 M NaOH for 5 minutes at RT, then placed on magnetic stand for 1 minute.

Supernatant was removed and the beads were washed with 150 µl of WASH buffer (50 mM NaCl, 30 mM Tris pH=8, 0.1% Triton X-100) supplemented with 1 µM Tn5MERev primer and 0.1% BSA and mixed at 9 r.p.m. on a tube rotator for 5 minutes. On magnetic stand, supernatant was then removed and the chemical single stranding step was repeated one more time. Bead pools were then assembled with the overexpressed purified Tn5 transposase over 1-3 days on a tube rotator at 4° C. in 1 ml of dialysis/storage buffer (100 mM HEPES-KOH PH=7.2; 0.2 M NaCl, 0.2 mM EDTA, 0.2% Triton X-100, 20% glycerol). The amount of Tn5 transposase needed per volume of beads (here we used 480 μl of M-280 beads divided in 4 pools of 120 μl of beads each) varies depending on the batch of Tn5 transposase and needs to be titrated in a small-scale experiment to find the optimal ration of Tn5: initial beads volume. Assembled beads (120 μl of initial M-280 beads per each pool) were then washed twice with 1 ml of dialysis/storage buffer and stored in 600 μl of dialysis/storage buffer at 4° C. (5 μl of initial M-280 beads in 25 μl) until tagmentation.

As a proof-of-concept, an experimental cross between mice of inbred strains BL6 and CAST was generated. The resulting F1 hybrid mouse would thus inherit one whole chromosome from each parent and be fully heterozygous at all positions that differ between BL6 and CAST. Previous in-depth sequencing and de novo assembly of the two strains by the Wellcome Trust Sanger Institute has revealed a total of 6,620,436 biallelic SNPs between the strains across the autosomes and the X chromosome (it should be noted here that these previous chromosome length assemblies combined multiple long- and linked-read sequencing platforms and specialized techniques, most of which are beyond the capabilities of individual laboratories). An additional advantage is that the reference mouse genome was created from the BL6 strain, such that for each chromosome, one of the two haplotypes consists exclusively of reference ("0") alleles, and the other one exclusively alternate (ALT or "1") alleles. This is schematically depicted in FIG. 9. To demonstrate the feasibility of resolving haplotypes, HMW target genomic DNA was extracted from the spleen of an F1 (BL6×CAST) mouse using a Qiagen MagAttract HMW DNA kit, and separately subjected to 10× Chromium and haplotagging library preparation procedures. In the case of haplotagging, 1.5 ng of genome the HMW DNA was tagmented with 5 μl, estimated to be 3-3.5 million beads carrying all possible A, B and D duplexes, but only a subset of C duplexes from 1-24. The tagmented target DNA was then PCR amplified with 13 cycles as described in Example 6. FIG. 15 shows the libraries amplified from the beads. The first lane shows the sample described in this Example. Other than the increased barcode diversity the procedure was identical to that described in Example 6. Other additional samples with varying input DNA amount or bead volumes are shown as additional lanes to the right. The entire procedure of tagmentation, clean-up and PCR amplification took less than 4 hours to create Illumina® sequencing-ready libraries from extracted DNA. For the 10× Chromium technique, a Chromium Controller was used together with the Chromium Genome Chip and associated kit and was performed over 3 days.

The resulting sequencing library from haplotagging was submitted as an otherwise standard Illumina Nextera® lane with 12 cycles of i7 and 13 cycles of i5 index sequencing. No other customization was required. It was sequenced with 7 other Nextera and TruSeq lanes in a standard flow cell on an Illumina HiSeq3000 instrument.

The raw sequencing data was converted into fastq basecalls and broadly demultiplexed into the 4 sub-segments using Illumina's Bcl2fastq® software (v2.17.1.14 with the following parameters —use-bases-mask=Y150,Y12,17Y6, Y150 —minimum-trimmed-read-length=1 —mask-shortadapter-reads=1 —create-fastq-for-index-reads—barcode-mismatches=0 (Illumina®; and where applicable, demultiplexed by input samples by the "C" or "D" segments of the beadTag barcode). Then parsing of the A, B, C and D segmental barcode and beadTag assignment was performed using the custom programme filterFastq_by_bc described in this Disclosure. The fastq file contained 74,576,306 reads, with average quality of 38.3 in PHRED scale and total sequence of 10.87 Gbp. Other lanes in the same run showed no discernible decrease in quality or throughput. Together the results show that Illumina® sequencing of haplotagged libraries were successful.

EXAMPLE 9—ERROR RATE ESTIMATE FROM INDEX READS

In the dataset generated under Example 8, oligonucleotides with an invariable "A/T" and "C/G" annealing base-pair were used to form position 7 in both i7 and i5 indexing reads, respectively (designated as positions "L1" and "L2" in FIG. 1b). The sequencing error rate at this position was used to estimate the empirical Illumina® sequencing error rate of the indexing reads to be around 2% (see Table 4). This is much higher than the typical error rate in Reads 1 and 2, which should be below 0.5%.

Based on the 2% per nt error rate estimated in Table 4, the error rate to the full 6 nt barcode segment was extrapolated, as well as the combined length of 2 segments (12 nt) or all 4 segments (24 nt). This shows that the fraction of error-free barcodes drops rapidly with increasing barcode length to as low as 44% for a 24 nt barcode. This will result in large loss of data and will impact the ability to properly reconstruct haplotype molecules. However, if error correction is applied to individual A, B, C and D segments (6 nt in length), 98.5% of reads can be retained per segment, giving an overall successful demultiplexing rate of 94%. The table illustrates nicely that the segmented barcode structure employed in the context of the present invention allows for a higher barcode correction than using a non-segmented barcode of the same length. Moreover, it is important to note that the short segments of the barcode sequences allow a much easier, less memory requiring and faster demultiplexing.

EXAMPLE 10—DEMONSTRATION OF THE FEASIBILITY OF LINKED-READ SEQUENCING OF LIBRARIES GENERATED THROUGH HAPLOTAGGING

The modified fastq file (as generated in Example 8) was placed against the mouse reference genome assembly mm10 using the software bwa. v0.7.10-r789 (Li and Durbin, 2010, loc. cit.) and processed using samtools v1.2 (Li et al., 2009, loc. cit.), marking and ignoring PCR and optical duplicate reads in subsequent analyses. The set of positions known to be different between the BL6 and CAST strains (Mouse Genomes Project version 3 dbSNP v137 release (Keane et al., Nature 2011, 477:289-294) were evaluated to determine the haplotype(s) of the molecule. Custom Perl and bash scripts were developed to extract the reads overlapping 6,620,436 biallelic SNP positions in the genome. These positions were parsed to determine if a given read carries reference (REF or "0") or alternate (ALT or "1") alleles and associate their Phred-scaled quality score with the beadTag encoded with the BX tag under the Sequence Alignment/Map format specification (Li et al., 2009; this follows the same convention used by 10× Genomics for parsing in their longranger programme). By summing the Phred-scaled quality score over all observed reads sharing a beadTag, the consensus REF or ALT state at a given position was determined, and the resulting series of SNP alleles was recorded as consecutive strings of 0 or 1.

The beadTag output was then parsed to identify "molecules", following the same definition used by longranger by defining each molecule as a cluster of reads sharing the same beadTag with a maximum gap of 60 kbp between reads. The molecules for the SNP alleles were then analysed and classified as "concordant" if a given position belongs to the majority allele and otherwise as "discordant" positions. Molecules overlapping 2 or fewer SNPs were discarded. Other molecules with one or no discordant positions were assigned accordingly to Haplotype 0 or Haplotype 1. The remaining molecules with 2 or more discordant positions were classified as "mixed molecules".

A corresponding sequencing lane using 10× Genomics' Chromium v2 chemistry was also performed on the exact template DNA extraction from the F1 (BL6×CAST) hybrid mouse, with input amount set to be 0.7 ng, or approximately 1000 diploid genome copies, as recommended by the manufacturer. All following steps were performed as recommended by the manufacturer as well: target DNA was encapsulated in microdroplets under the control of the 10× Controller as described. The 10× Chromium linked-read library was also sequenced by the HiSeq3000 instrument, in this case using the cycling condition of 150+8+8+150. Subsequent demultiplexing was performed by Illumina's Bcl2fastq® and then followed by 10× Longranger. The Longranger programme, in particular, performs trimming and comparison of the barcodes from Read 1, which resulted in about 14% reduction in sequencing output (16 bp barcode and 5 additional bp trimmed, yielding 129 bp in Read 1). Placed sequences were then reanalyzed at the known sites differing between BL6 and CAST for their allelic counts in an identical pipeline as described above for haplotagging.

The sequencing and phasing results are shown in FIG. 16A and Table 6. They show clear evidence that haplotagging reliably tagged the two intact haplotypes. FIG. 16A shows the results for molecule assignment to Haplotypes REF, ALT and MIX along Chromosome 19. FIG. 16B shows the corresponding result generated using 10× Genomic's Chromium v2 chemistry as a comparison following the procedure described in the previous paragraph. FIG. 16A shows clearly that with haplotagging the vast majority of molecules are assigned to one of the two biological haplotypes and has extremely low rates of molecules with discordant SNPs (99.95%, also see Table 6 for genome-wide summaries). Table 6 shows the summary statistics from the haplotype analysis, broken down by molecules. The molecules span an N50 of 38.3 kbp, a far larger number than the approximately 600 bp spanned by typical tagmented short reads. In contrast, only a total of 836 molecules (0.05%) contain mixed REF and ALT alleles with at least two discordant SNPs. Such mixed molecules may be the result of cross-tagging during haplotagging, template switching during PCR amplifications, barcode collision, or actual recombinant molecules. Table 6 also indicates that the mixed molecules tend to show greater average number of reads per molecule and span, further supporting the interpretation that such molecules come from overlapping placements of two molecules from different haplotypes. This low rate of mixed molecules from haplotagging likely reflected the success of minimizing barcode collision, thus validating the advantages of the combinatorial barcode design and the barcode segment-based error detection and correction analysis during multiplexing.

A comparison against the current standard linked read sequencing technique by 10× Chromium shows very similar number of molecules matching the REFERENCE haplotype (20556 for haplotagging vs. 17885 from 10× Chromium), ALTERNATE haplotype (19845 vs. 16910 molecules). However, there is lower number of discordant molecules for haplotagging (25, 0.06%) vs. 10× Chromium (765, or 2.1%). The low number of discordant molecules documents that the inventive segmented barcode design with predefined barcode segments employed by the haplotagging technology significantly reduces barcode collision. Besides this advantage, the haplotagging approach has the advantage of far lower costs (since no micro fluidic instrumentation is required and multiplexing is available) and ease of use, highlighted in the next paragraph.

A key practical advantage of haplotagging is its ease of use, high multiplexing capacity and, thus low costs. This is shown in Table 7. For comparison, typical operating costs (excluding one-time costs for e.g., instrumentations) for preparing sequencing libraries with conventional short-read sequencing (TruSeq), Tn5-based Nextera short-read sequencing, 10× Genomics Chromium linked-read sequencing or haplotagging are shown. It shows that haplotagging is about 100 times cheaper than the commercially available Chromium linked-read sequencing platform, while delivering additional advantages (e.g. lower number of discordant molecules due to reduced barcode collision).

EXAMPLE 11—FURTHER COMPARISON BETWEEN HAPLOTAGGING AND 10× CHROMIUM LINKED READ SEQUENCING TECHNOLOGY

To illustrate the power of haplotagging and to compare its performance with the commercially available 10× Chromium linked read sequencing technology, a further comparison against a general benchmark reference genome was performed. For this example, DNA from the human lymphoblastoid cell line GM12878 was freshly extracted with a magnetized nanostructure silica disc (fabricated following Zhang et al., Adv. Mater. 2016, 28 (48): 10630-10636). The sample was resuspended in 20 µl PBS and 30 µl Protease K (Circulomics, Baltimore, MD, USA). Then, cell lysis was started with 200 µl PureLink Genomic Digestion Buffer (Thermo-Fisher) and briefly vortexed to mix. The sample was incubated on a ThermoMixer® at 55° C. and 900 rpm for 30 min. 10 µl of RNase A was added to the sample and incubated at RT for 10 min. Lysis was neutralized with 220 µl PureLink Genomic Lysis/Binding Buffer (Thermo-Fisher) and the tube was mixed by inverting 20-30 times, followed by 30 min incubation on a ThermoMixer® at 55° C. and 900 rpm. 2 silica discs, 3 mm in diameter, and 250 µl of isopropanol were added to the lysate to bind the DNA, and mixed by inverting the tube 10-20 times. The sample was further mixed on a tube rotator at 9 rpm at RT for 10 min. The disc was bound on a magnetic rack and the supernatant was removed. The disc was washed with 800 µl of 80% ethanol, then mixed by inverting 10 times. Supernatant was removed and the washing step was repeated. Sample was briefly spun in a mini-centrifuge for 2 s to fully collect residue ethanol for removal. To elute, 100-200 µl of Elution Buffer (10 mM Tris, pH 8.0) was added to the disc and incubated at 50° C. for 30 min. The tube was then spun for 5 s to collect the eluate and the eluate was transferred to a new 1.5 ml microcentrifuge tube.

Tagmentation with haplotagging beads was then performed by mixing 2 ng of the HMW DNA with 5 µl haplotagging beads from the same bead batch as described in Example 8 (approximately 3.5 million beads carrying all possible A, B and D duplexes, but only a subset of C duplexes from 1-24). The tagmented target DNA was then PCR amplified with 12 cycles as described in Example 6.

The resulting sequencing library from haplotagging was submitted as an otherwise standard Illumina Nextera® lane with 13 cycles of i7 and 12 cycles of i5 index sequencing. No other customization was required. It was sequenced with 7 other Nextera and TruSeq lanes in a standard flow cell on an Illumina HiSeq3000® instrument.

The raw sequencing data was converted into fastq basecalls and broadly demultiplexed using Illumina's Bcl2fastq® software (v2.17.1.14 with the following parameters —use-bases-mask=Y150,113,112, Y15 —create-fastq-for-index-reads. Then parsing of the A, B, C and D segmental barcode and beadTag assignment was performed using the custom programme filterFastq_by_bc described in this Disclosure. The fastq file contained 552,173,840 reads, with average quality of 36.4 in PHRED scale and total sequence of 82.83 Gbp based on the entire raw fastq count.

The sequences were then placed against the human reference genome assembly GRCh38. The phased SNP set was downloaded from ftp://ftp-trace.ncbi.nlm.nih.gov/giab/ftp/release/NA12878_HG001/latest/GRCh38/(Genome-in-a-bottle consortium). Molecules were called using custom scripts that examined the known SNP positions and their allelic states, and grouped together by sequencing reads sharing the same barcode with a maximal internal gap distance of 60 kbp. The 10× Chromium data was downloaded from 10× Genomic's website (found on the world wide web at support. 10× genomics.com/genome-exome/datasets/2.2.1/NA12878_WGS_v2), and we used 10×'s annotation for a given molecule.

FIG. 24 shows that haplotagging produced a median of 14 reads per molecule, compared to 17 reads from 10× (yet, the 10× dataset has about 33% deeper coverage). The median haplotagging molecule spanned 40.6 kbp vs. 39.7 kbp from 10× Chromium. This further reinforces that haplotagging shows a powerful performance in linked read sequencing that is even slightly better than the commercially available 10× Genomics Chromium setup regarding the median molecule length spanned.

EXAMPLE 12—COMPARING THE EFFECT OF BARCODE DIVERSITY IN MINIMIZING BARCODE COLLISION

The inventor's idea was that the probability of barcode collision may decrease with increasing barcode diversity. This difference was evaluated by comparing the data generated in Example 6 (1024 combinations) and Example 8 (21.2 million combinations). For each dataset, the mapped positions of the 10 most common beadTags on Chromosome 11 were plotted in FIG. 17. FIG. 17 shows the results from the two datasets separately, with each barcode shown in a row and the number of hits in a given megabase as height. The data shows that with a highly increased barcode diversity, there are only very few clusters found along the chromosome for a given barcode, and they are typically separated by megabases and thus allow unambiguous identification of the original molecule. In contrast, when there is insufficient barcode diversity, such as the case of using only 1024 barcodes, the clusters of reads carrying the same barcode are broadly distributed, leading a very high probability of barcode collision.

EXAMPLE 13—REMOVAL OF EXCESS ADAPTERS THROUGH EXONUCLEASE CLEAN-UP

The inventors speculated that there could be an excess of oligonucleotides from leftover reagents during heteroadapters ligation, assembly, Tn5 transposase loading and tagmentation.

Some of these oligonucleotides may act as primers for the PCR amplification of the sequencing library and, thus, negatively affect library generation. For instance, such oligonucleotides serving as primer in the final PCR amplification step may lead to barcode switch. A clean-up step prior to PCR amplification was therefore evaluated for the feasibility of specifically removing unused primers while leaving tagmented DNA intact.

FIG. 18 shows the various types of oligonucleotides that may be present at the point of PCR amplification, e.g., free duplexes, attached but unused adapters, as well as transposed heteroadapters, the latter of which correspond to the desired PCR amplification template for the sequencing library. Efficient removal of the first two classes of oligonucleotide can be achieved through the combined use of lambda exonuclease and exonuclease I in a single reaction. This is due to the specific action of lambda exonuclease in targeting phosphorylated 5' end of double-stranded DNA (dsDNA), but not gaps or nicks in dsDNA. For unphosphorylated but exposed 5' ends in free duplexes, lambda exonuclease has reduced but adequate ability to digest away the reverse strand featuring the 5' overhang. This preserves the transposition products from being degraded by lambda exonuclease. Upon completion of lambda exonuclease activity, exposed single-stranded DNA now become substrate for exonuclease I digestion in the 3' to 5' direction. This results in efficient clean-up of excess primers and help minimize barcode switching in subsequent PCR amplification due to mis-priming of barcoded—but exposed and unused-adapters between beads.

To evaluate the efficiency of the exonuclease cocktail, 15 μl of 0.5 μM A1-8 duplex or 15 μl of 1 μM C1-8 duplex were mixed together with 20 μl 1× Lambda Exo buffer. Then four conditions with no enzyme, 0.5 μl lambda exonuclease only, 0.5 μl exonuclease I only; or 0.5 μl each of lambda exonuclease and exonuclease I were tested for their ability to digest the duplexes. The reaction mixture was then incubated for 20 minutes at 37° C.

FIG. 18B shows the result of the reaction. It shows that the lambda and exonuclease I mixture were very efficient in digesting each type of duplexes on their own. In a separate example, 4 different haplotagged samples were tested with the following conditions: 4 parallel reactions of tagmentation beads in 80 μl reaction volumes with 3 ng of HMW DNA were incubated for 10 minutes at 55° C., then 80 μl of WASH buffer (50 mM NaCl, 30 mM Tris pH=8, 0.1% Triton X-100) containing 0.6% SDS was added to each sample; samples were mixed by inverting the tubes and incubated at 55° C. for another 10 minutes to inactivate and strip Tn5 from DNA. The beads from these reactions were pooled together, then re-aliquoted into 4 tubes containing 30 μl of 1× Lambda Exonuclease buffer, with the following conditions: both lambda exonuclease and exonuclease I; lambda exonuclease only; exonuclease I only; or no exonucleases. These reactions were incubated for 20 minutes at 37° C., beads were then washed twice with WASH buffer. Q5 High-Fidelity DNA Polymerase was used to amplify the haplotagged DNA bound to the beads using 4 μl of 10 μM PCR primers, TruSeq-F SEQ ID NO: 13 and TruSeq-R SEQ ID NO: 14, in a 50 µl reaction according to manufacturer's instructions, with the following cycling conditions: 5 min at 72° C., 30 sec 98° C. and 14 cycles of: 98° C. for 15 sec, 65° C. for 20 sec and 72° C. for 60 sec. The resulting reactions are shown in FIG. 18C. It shows that in all cases, the treatment with the exonuclease mix does not impede the amplification of the sequencing library from the tagmented DNA. Combined with the previous result showing efficient unused primer removal, the clean-up reaction was determined to be useful in improving the efficiency and specificity of haplotagging.

EXAMPLE 14—DEMONSTRATION OF THE FEASIBILITY OF ELIMINATING OVERHANGS OR INTERVENING SEQUENCES DURING THE LIGATION OF CONTIGUOUS BARCODE SEGMENTS

Given the strictly limited length of the index reads in the Illumina® standard sequencing protocol, the feasibility of directly concatenating barcode segments was tested. The main challenge here is that ligation of DNA segments with blunt ends, or 1 basepair overhangs under standard conditions is inefficient. Example 7 shows one approach to minimize the overhangs to 1 basepair (5') using Blunt/TA ligase. An alternative approach using the naturally occurring degenerate nucleobase deoxyinosine was tested. To attach the first A segment, a 5' phosphorylated universal adapter oligonucleotide Universal_anchor_P7 (SEQ ID NO: 1993) featuring the "bottom strand" (5 µl) was attached to 5 µl of M280 bead via the streptavidin-biotin bond, here at the 3' end in a 0.2 µl tube on a magnetic stand. The binding was allowed to proceed by changing the bead storage buffer to the streptavidin binding buffer. Upon the addition of the Universal_anchor_P7 primer, 100 µl fresh streptavidin binding buffer was added. The tube was rotated for 30° C. at RT, and the beads were washed three times with 150 µl of WASH buffer (50 mM NaCl, 30 mM Tris pH=8, 0.1% Triton X-100).

The universal adapter was then annealed to an asymmetric A duplex, consisting of primers AlphaFor57 and AlphaRev57 (SEQ ID NO: 1994 to 1995), here carrying the barcode A57 as an example. The asymmetric duplex was designed such that it carries from 5' to 3' direction an anchoring annealing segment spanning 10 basepairs, the A57 barcode segment, and finally terminating with an extension featuring a MlyI site. The duplex was annealed by mixing 5 µl of the forward and 5.5 µl of the reverse primers (100 µM) to adjust the duplexes to a concentration of 10 µM. The primers were heated to 95° C. for 2 min, then gradually allowed to cool to 30° C. over 65 cycles of 1 min with a decrease of 1° C. per step. The annealing created a junction spanning 10 basepairs.

Ligation to the P7 anchor primer was performed by adding 2 µl A duplex (10 µM) in 6 µl 1× annealing buffer and 8 µl 2× Blunt/TA Ligase Master Mix (NEB). The tube was gently tapped to mix and re-suspend the beads and was rotated at RT for 10 minutes. The beads were then washed the beads 3 times for 5 minutes each with 150 µl of WASH buffer.

Next, a new 5' phosphorylated end was created by restriction enzyme via the engineered sites MlyI. The restriction digestion was performed by removing the WASH buffer and adding 30 µl of 1× CutSmart buffer (NEB) with 1 µl of MlyI. The reaction mix was incubated at 37° C. for 30 minutes. The beads were then washed twice for 5 minutes with 150 µl of WASH buffer, and then remove the last wash. The unanchored strand was removed by adding 30 µl of 1×NEBuffer 1 supplemented with 1 µl (100 U) of Exonuclease III (NEB). The reaction mixture was then incubated at 37° C. for 30 minutes. Excess enzyme were washed and removed by adding 100 µl WASH buffer supplemented with 0.6% SDS, incubate at 37° C. for 5 minutes, and the beads were washed twice for 5 minutes with WASH buffer.

The next segment B, exemplified by the asymmetric duplex B20, consisting of BetaFor20 and BetaRev20 (SEQ ID NO: 1996 to 1997), was then annealed like duplex A and added to the beads. The asymmetric B duplex differed from the A duplex in that between the anchoring 10 nt annealing segment was followed by 6 deoxyinosine bases, then the B20 barcode segment, and finally terminating with an extension featuring a MlyI site. The annealing thus created a junction spanning a total of 16 basepairs (10 specific and 6 universal). Ligation was performed with the same procedure as described above for duplex A.

To illustrate the feasibility of concatenating more than 2 barcode segments, a third C asymmetric duplex was added to the beads and annealed, exemplified by C20 here, formed by annealing of the primers GammaFor20 and GammaRev20 (SEQ ID NO: 1998 to 1999). The asymmetric C duplex differed from the B duplex in that the universal segment was extended to 12 deoxyinosine bases to cover the A and B barcode segments, followed by the C20 barcode segment and finally terminating with the reverse complement of the Tn5A transposon sequence (SEQ ID NO: 7). The annealing thus created a junction spanning a total of 22 basepairs (10 specific and 12 universal). Ligation was performed with the same procedure described above for duplexes A and B but omitting the MlyI enzyme digest.

To evaluate if the sequence were assembled correctly, a PCR was performed with the Tn5MERev (SEQ ID NO: 9) and the i7-LongTruSeq primers (SEQ ID NO: 2000). PCR was performed with following cycling conditions: 98° C. for 30 s followed by 10 cycles of: 98° C. 15 s, 55° C. for 20 s and 72° C. for 20 s. FIG. 20 shows the resulting PCR product, which clearly shows a strong, single band approximately of the expected size of 78 bp. The PCR product was cut from the agarose gel and purified using MinElute PCR Purification Kit (Qiagen). 10 ng of PCR product were sub-cloned into 50 ng of pJET1.2 vector using CloneJET PCR Cloning Kit (Thermo-Fisher) and transformed into DH5 alpha competent cells. Following an overnight incubation, 40 of the ampicillin resistant colonies were picked from the agar plate into 14 µl of H2O. These served as template for PCR amplification and sequencing: 2 µl of each of the picked colonies was used in 25 µl Q5 polymerase amplification reaction and 32 PCR cycles to amplify the insert using specific to the pJET1.2 vector (pJET1_2For and pJET1_2Rev, SEQ ID NO: 2001-2002). The expected amplicon sizes were 197 bp (78+117 bp) or 117 bp for an empty plasmid junction. The PCR reaction was purified with AMPure Magnetic Beads and 10 ng of the purified PCR product was sequenced using the pJET1_2For sequencing primer (SEQ ID NO: 2001) using an ABI3730x1 (Life Technology) capillary sequencer.

FIG. 21 shows the resulting sequencing electropherogram traces. It shows that the serial ligation procedure created contiguous barcode segments without overhangs or any intervening sequences in many independent clones. This shows that it is possible to consistently generate consecutive barcodes without linker sequences between barcode segments. This result suggests that it is possible to encode even greater diversity in the limited number of nucleotides of the indexing reads.

The general principle of the method is schematically depicted in FIG. 22.

EXAMPLE 15—CONSTRUCTION OF BARCODE SEGMENTS WITHOUT LINKER SEQUENCES

As demonstrated in Example 14, above, it is feasible to generate barcode sequences with a segmented structure using a linker-free configuration. This has the advantage that the segmented barcode sequences can be generated shorter or with even higher divergence than with a linker based ligation strategy. Given the limit in sequencing cycles available for placing barcodes using the Illumina Nextera® technology, this allows an even more efficient use of the indexing positions i5 and i7 for barcoding in haplotagging.

Haplotagging beads using this linker-free barcode configuration can be assembled as described in the following and as schematically depicted in FIG. 23. Briefly, the strategy consists of using a universal "anchor" oligonucleotide (SEQ ID NO: 2003) that directly binds the solid support and ligating additional barcode segments in a stepwise fashion. Each of the ligation steps is mediated by a branched oligonucleotide duplex, of which the annealing segment is composed of tracts of moieties that have the ability to form stable base-pairing with a variety of standard oligonucleotide. Exemplary moieties that can fulfill such goal may be deoxyinosine, or 5-nitroindole.

First, in each well of a 96-well plate (Duplex-A plate), equal molar amounts of universal anchor oligonucleotide (SEQ ID NO: 2003), one of 12 of A-barcoded (AFor_5_CAGGAA, AFor_7_CCACAA, AFor_8_AGGCAA, AFor_12_CGAAGA, AFor_25_GTCTCA, AFor_29_CTCCTA, AFor_58_TAGTGC, AFor_63_CATTCC, AFor_68_AACCTC, AFor_75_ACGTGT, AFor_91_AGTCAG, AFor_95_GTTACG, SEQ ID NOs: 2007 to 2018) oligonucleotides and a universal-iN6-oligonucleotide (SEQ ID NO. 2004) are annealed by temperature ramping on a thermocycler from 98 to 40° C., at 1° C. per min. "IN" stands for the degenerate nucleobase deoxyinosine which can pair with all four naturally occurring nucleobases. In a second 96-well plate (Duplex-B plate), equal molar amounts of one of 12 B-barcoded (BFor_6_GAAACC, BFor_40_ACGAGA, BFor_50_TTGAGC, BFor_52_GACTAC, BFor_68_CTCAAC, BFor_73_GGTTCT, BFor_77_GCTACA, BFor_78_GCTTAG, BFor_80_CCTATG, BFor_82_TCTGCT, BFor_84_CTTCAG, BFor_85_TCGTAC, SEQ ID NOs: 2019 to 2029) oligonucleotides and a universal-iN12-oligonucleotide (SEQ ID NO. 2005) are annealed on a thermocycler from 98° C. to 40° C., at 1° C. per min. Then, in a third 96-well plate (Duplex-C plate), equal molar amounts of one of 8 C-barcoded (CFor_4_AAGGAG, CFor_5_AACAGG, CFor_37_GGTTGA, CFor_42_CGTTAC, CFor_49_TGTCGT, CFor_70_ATGCCA, CFor_73_GTTCTG, CFor_87_ TCC-CAT, SEQ ID NO. POSITIONS 2031 to 2038) oligonucleotides and a universal-iN18-oligonucleotide (Universal_dI18_Tn5B, SEQ ID NO. 2006) are annealed on a thermocycler from 98° C. to 40° C., at 1° C. per min. Finally, in a forth 96-well plate (Duplex-i5-Tn5ME-A plate), equal molar amounts of one of 96 barcoded and 5'biotinylated-i5-Tn5ME-A (SEQ ID: 2039) oligonucleotides and Tn5MErev oligonucleotide (SEQ ID NO. 9) are annealed on a thermocycler from 98° C. to 40° C., at 1° C. per min.

Following annealing of the four types of duplexes, the assembly starts with binding the A duplexes (of Duplex A plate) to streptavidin beads. First, equal amount of streptavidin coated magnetic beads (Dynabeads M-280 Streptavidin, Thermo-Fisher) are pipetted and bound with one of the A-barcoded Duplexes (A1-96) in Streptavidin binding buffer (SBB buffer: 0.6 M NaCl, 20 mM Tris buffer pH 8, 0.5 mM EDTA, 0.1% Triton X-100). Beads are washed twice with Wash Buffer (50 mM NaCl, 30 mM Tris pH=8, 0.1% Triton X-100) and are then incubated with 1 µl of 1× Blunt/TA Ligase Master Mix (NEB), which includes in its mix also the active ligase, to ligate the annealed DNA strands. Beads are incubated at room temperature for 10 min, and are then washed twice with wash buffer. Following annealing, the extended barcode strand (5') is recut and re-exposed by the restriction enzyme SapI. This will be done by adding CutSmart buffer (NEB) supplemented with 1 µl of SapI restriction enzyme (NEB) in each well and incubated at 37° C. for 30 min. Beads are subsequently washed twice with Wash Buffer. To remove the reverse strand, 1 µl of lambda Exonuclease (NEB) in 1× Lambda Exonuclease Reaction Buffer is pipetted in each well. Beads are incubated for 30 mins at 37° C. and are then washed twice with Wash Buffer. This completes the first step of assembly by attaching the A segment to the anchor oligonucleotides (bearing a biotin moiety that interacts with the streptavidin bead).

To continue with the assembly of B-duplexes, beads from all 12 wells are transferred into a single 1.5 ml Eppendorf tube (i.e. the beads are pooled), mixed well and aliquoted into 12 wells of a new 96-well plate. Then, one of the B-barcoded Duplexes (B1-12) is pipetted in each well of the beads containing plate, followed by the addition of 1 µl of 1× Blunt/TA Ligase Master Mix (NEB) to ligate the annealed DNA strands. Beads are incubated at room temperature for 10 min, and are then washed twice with wash buffer. Following annealing, the extended barcode strand (5') is recut and re-exposed by the restriction enzyme SapI. This is achieved by adding CutSmart buffer (NEB) supplemented with 1 µl SapI restriction enzyme (NEB) in each well and incubated at 37° C. for 30 min. Beads are washed twice with Wash Buffer. To remove the reverse strand, 1 µl of lambda Exonuclease (NEB) in 1× Lambda Exonuclease Reaction Buffer is pipetted into each well. Beads are incubated for 30 min at 37° C. and are then washed twice with Wash Buffer. This will complete the second step of assembly by attaching the B segment to the A-segment oligonucleotides, making AB-duplexes.

To continue with the assembly of AB-duplexes, beads from all 12 wells are transferred into a single 1.5 ml Eppendorf tube (i.e. are pooled), mixed well and aliquoted into 8 wells of an 8-strip tube. Then, one of the C-barcoded Duplexes (C1-8) is pipetted in each well of the beads containing plate, followed by the addition of 1× Blunt/TA Ligase Master Mix (NEB) to ligate the annealed DNA strands. Beads are incubated at room temperature for 10 min, and are then washed twice with wash buffer. Since this is the last segment to be attached, the C duplexes are terminated by the Tn5B transposon sequence. To remove the reverse strand, 1 µl of lambda Exonuclease (NEB) in 1× Lambda Exonuclease Reaction Buffer is pipetted in each well. Beads are incubated for 30 min at 37° C. and then washed twice with Wash Buffer. This completes the full assembly of three segments A, B and C onto the anchor oligonucleotides. The assembled A, B and C polynucleotide corresponds to the first transposon for on bead tagmentation. Each of the assembled first transposons comprises three consecutive barcode segments ("A", "B", "C") without linker nucleotides in this example.

The remaining steps allowing the full assembly of the Tn5 transposome onto the solid bead support are performed as follows. First, the beads from all 8 wells are pooled and transferred into a single 1.5 ml Eppendorf tube. On a magnetic stand, wash buffer is removed and replaced with 0.15M NaOH for 5 min. Next, on a magnetic stand NaOH solution is removed and replaced with Wash Buffer containing an excess of Tn5MErev oligonucleotide (SEQ ID NO. 9). Beads are washed twice with Wash Buffer and aliquoted in all 96 wells of a new 96-well plate. Streptavidin binding buffer and one of the 96 duplexes of the Duplex-i5-Tn5ME-A plate is pipetted in each well of the beads containing plate. The Duplex-i5-Tn5ME provides the second transposon in this example. The second transposon in this example comprises only one barcode segment. The plate is then incubated at room temperature for 30 min. Beads are then washed twice with Wash buffer. At this point, all the beads contain both Tn5A and Tn5B heterodimer transposon complexes. To complete transposome assembly, Tn5 transposase is added to each well containing the beads and assembled at 4° C. for two days on a plate rotator. The bead concentrations are adjusted to be around 3.5M per 5 µl volume.

This Example is merely for illustrative purposes. Especially, the number of different barcode segments "A", different barcode segments "B and different barcode segments "C" in the first transposon may be varied (e.g., up to 96 sequences per segment). Moreover, also the second transposon may have more than one barcode segment, e.g., two or three barcode segments. In this event, the second transposon is assembled in the same manner as described for the first transposon rather than only employing the preassembled Duplex-i5-Tn5ME as second transposon.

Testing of the fully functional, assembled haplotagging beads (here composing of 96 Tn5A barcodes and 1152 Tn5B barcodes, or 12 A×12 B×8 C barcodes for a total of 110,592 barcodes for a pilot test for the linker-free assembly) may be performed as, in which we mix approximately 5 µl haplotagging beads (approximately 3.5M) with up to 4 ng of HMW DNA, e.g. from a (BL6×CAST) F1 hybrid mouse. The HMW is tagmented, PCR amplified and then submitted as a standard Illumina Nextera® library, with index cycles of 18 and 7 cycles for the i7 and i5 index reads, respectively. The resulting sequences may then be analyzed for the correct assembly of the barcodes and the extent of barcode sharing within a small genomic region consistent with single-molecule barcoding (as described in Example 10 above). We expect that the absence of linker sequences between the barcode segments and the successful recovery of a diversity of barcodes to confirm the success of linker-free barcode assembly for the purpose of haplotagging.

EXAMPLE 16—DEMONSTRATING THE FEASIBILITY OF HAPLOTYPE PHASING USING HAPLOTAGGING

The broad applicability of haplotagging was tested by performing phasing using data from human and two mouse samples. Haplotagging sequencing libraries were generated from fresh DNA extracted from the human fibroblast line GM12878, a F1 hybrid mouse between BL6 and CAST line as described in Example 8, as well as a mouse with an additional backcross generation (designated "N2" here). The libraries were sequenced on a HiSeq3000 platform as described previously in Example 8.

The results were evaluated against a known set of positions. For the human, this was obtained from the Genome in a Bottle Consortium (Zook et al., 2014, *Nat. Biotech.* 32, 246-251 or doi: 10.1038/nbt.2835), and for mouse, the Mouse Genome Project version 5 release as described in Example 8. The sequences were placed against the human (GRC38) and mouse reference genome assemblies (mm10) respectively using the same software pipeline as described in Example 10. Barcode sharing was determined based on error-corrected beadTags and grouped as molecules following the pipeline recommended by the software package HapCUT2 (Edge et al., 2016, *Genome Res.*, gr.213462.116 (2016). doi: 10.1101/gr.213462.116).

Phase blocks are sets of DNA variants, typically SNPs, that are inferred to be on the same chromosome based on their frequent co-occurrence on DNA molecules. If phasing is successful, these should span large proportions of the chromosomes. Phase blocks can be identified most efficiently in single individuals based on the investigation of positions differing between respective paternal and maternal chromosomes.

Table 8 shows key performance metrics of phasing performances obtained from the conducted experiments, along with a comparison to previously published results (e.g., see Zhang et al., 2017, loc. cit.).

In all three samples, very robust performance was obtained using haplotagging (Table 8). In particular, most heterozygous SNPs were phased (98.59% in humans and above 99.6% in mouse) with very long phasing blocks that span much of, if not the entire, chromosome (6.83 Mb in human, and 61.46 Mb in mouse-effectively end-to-end on a chromosome). The value of the phase block metric N50 was very high, ranging from 1.08 Mbp in human to 10.93 and 14.45 Mbp in the two mouse samples. Together with the high proportion of phased SNPs, it suggests that much of the genome can be resolved into the respective maternal and paternal phases. In many of these performance metrics, haplotagging showed superior performance compared to CPTv2-seq as described in Zhang et al. 2017 (loc. cit.). The main advantage of haplotagging is the low-cost, simple application of haplotagging, compared to the use of custom sequencing primers, or instrumentation with 10× Genomics's Chromium platform. Furthermore, both short and long switch error rates were extremely low, from 0.95% and 0.039% in humans to as low as 0.075% and 0.014% in the N2 (BL6×CAST) mouse sample.

EXAMPLE 17—APPLICATION OF HAPLOTAGGING TO LARGE-SCALE STUDIES IN NATURAL POPULATIONS

To demonstrate the feasibility of applying haplotagging to large population samples, including samples relevant to conservation and ecological studies, two related datasets from *Heliconius* butterflies from Ecuador were generated. This dataset consisted of 484 samples from the species *Heliconius erato*, and 189 samples from the species *Heliconius melpomene*. Upon receiving the *Heliconius melpomene* samples as dissected tissues, the DNA was extracted, a quality control performed and haplotagging libraries generated for *H. melpomene* and *H. erato* over two weeks and a month, respectively. The samples were then multiplexed in batches of 96 libraries and sequenced on 10 separate lanes using a HiSeq3000 instrument.

At this scale, such a project was only possible due to the high-throughput nature of haplotagging and would have required 24 and 60.5 microfluidic chips (8 samples each), and an associated two work days each if the same experiment were to be performed using 10× Genomics' platform. This would correspond to 48 and 120 work days assuming sequential operation, for the 189 and 484 samples respectively. In addition, it would also have been impractical to perform the Chromium assay due to the very high projected costs of 29,516€ list price per 96 samples, or approximately 59,000€ and 147,580€ for the two data sets respectively. Even assuming favourable bulk discounts, e.g., 50%, the experiment would still have cost in excess of 100,000€ before including sequencing costs, without reiterating the labour costs. In contrast, using haplotagging the entire experiment could be performed by a single skilled scientist within a month, within 1500€.

Results of sample coverage estimations are shown in FIG. 25 and of phase block N50 estimations in FIG. 26. The median read coverage obtained was 2.72× and the median molecule coverage 19.40×. The mean phase block N50 across the 189 *H. melpomene* individuals was 3.33 Mbp. Comparing these results to those shown in single samples in Table 6, it can be seen that population-level sequencing and phasing using haplotagging is feasible and scalable.

In large sequencing projects, a typical guideline for per-sample sequencing depth would be around 10× per sample to be considered sufficient. Under this guideline, a comparable project would require 5 times as much sequencing throughput. Instead of 10 lanes of sequencing, 60 lanes of sequencing, or the equivalent of 7.5 HiSeq3000 whole flow cells. At current costs levels of around 18,000€ per flow cell, this would have cost another 135,000€ for the sequencing project. Instead, using haplotagging the molecular coverage could be leveraged (19.40×, well above the 10× recommended threshold), and data collection completed with 1.25 flow cells, or 21,500€.

To summarize, practical benefits of haplotagging were demonstrated, e.g. the possibility to obtain results within 25,000€ that would have required investment well in excess of 341,000€ had this experiment been done, e.g., using the 10× Chromium platform.

EXAMPLE 18—DETECTION OF STRUCTURAL REARRANGEMENTS IN *HELICONIUS ERATO* BUTTERFLIES

The DNA sequences from the 484 *H. erato* butterflies (cf. Example 17) were investigated and the pattern of barcode sharing between adjacent 10 kbp windows determined. This approach was used to evaluate the genome assembly for its correspondence to physical sequences of DNA as presented by the DNA molecules prepared by haplotagging.

In most regions of the genome, beadTag sharing was found only between 10 kbp windows that were very near each other, confirming that these regions of the genome assembly corresponded to the actual order of DNA from these populations. However, on Chromosome 2 in some highland *H. erato* butterflies, high incidences of beadTag sharing between windows near 0.75 Mbp and 1.87 Mbp were detected (FIG. 27, top). Specifically, the pattern showed that windows to the left of the 0.75 Mbp ("left outer") junction tended to share beadTags with sequences to the left of the 1.87 Mbp ("right inner") junction, and likewise between the left inner junction and the right outer junction. This pattern suggested that there has been an inversion of the DNA sequence between these junctions in the highland butterflies. This finding was surprising, because previous surveys of the population depended entirely on short read sequencing, which had little power, if any, to directly detect structural rearrangements. In a previous study, Nadeau and colleagues have shown evidence that a number of ecologically important traits cluster at this locus (Nadeau et al. 2014, *Genome Res.*, doi: 10.1101/gr.

169292.113). However, they were not able to ascertain the nature of this locus as an inversion due to their earlier technology. Accordingly, by analyzing differences in DNA sequence itself, a region of elevated DNA differences that corresponded strongly with the detected inversion could be detected (FIG. 27, bottom).

Hence, this Example clearly shows that haplotagging can be applied in real-world natural populations to identify chromosome rearrangements.

EXAMPLE 19—ADDITIONAL MATERIALS AND METHODS

Animal Care and Use

All experimental procedures described in this study have been approved by the local competent authority: Regierungspräsidium Tübingen, Germany, permit and notice numbers 35/9185.46-5 and 35/9185.82-5.

Reference Genome Assembly

All co-ordinates in the mouse genome refer to *Mus musculus* reference mm10, which is derived from GRCm38.

Tn5 Transposase

Sequencing libraries for high-throughput sequencing were generated using Tn5 transposase expressed as previously described (Picelli et al., 2014, loc. cit.). Briefly the bacterial expression plasmid pTXBX1-Tn5 (Addgene plasmid #60240) containing the hyperactive Tn5 transposase (carrying the E54K, L372P mutations, SEQ ID NO: 12) fused to an intein chitin-binding domain was transformed into the C3013 competent cells (C3013L, New England BioLabs®, Frankfurt am Main, Germany). Expression was induced under addition of isopropyl β-D-1-thiogalactopyranoside (IPTG) and cells were lysed using an Emulsiflex c3 (Avestin, Mannheim, Germany). The lysate was applied to a chitin resin column (New England BioLabs®, S6651S). The Tn5 transposase domain was cleaved and eluted using 1,4-dithiothreitol (DTT, Sigma Aldrich®, Taufkirchen, Germany, 000000010197777001). Concentration of the eluted protein and DTT removal was achieved through a concentration column with a cut-off of 10 kilodalton (Amicon Ultra-15, 10 kDA, #UFC901024, Merck-Millipore, Darmstadt, Germany).

Oligonucleotide Design

Custom oligonucleotides were synthesized by Integrated DNA Technologies (Leuven, Belgium) at ready-to-use 10 μM concentration in a 96-well plate format. Oligonucleotide employed are listed in the sequence listing.

Sequencing Library Construction

To prepare 4 haplotagging libraries that could be multiplexed on a single lane of HiSeq3000 run, 1.5 ng high-molecular weight DNA (HMW DNA) and 25 μl of the pooled haplotagging beads were transferred into 4 tubes of a 8-tube-PCR-strip. In another 8-tube-PCR-strip, tagmentation mixture was prepared by adding in each tube 110 μl of H2O, 10 μl 0.15 ng/μl HMW DNA and 30 μl of 5×TAPS-Mg-DMF buffer (50 mM TAPS pH 8.5 with NaOH, 25 mM MgCl2, 50% N,N-dimethylformamide). Next, while on a magnetic stand, storage buffer was removed from the beads and the HMW DNA-TAPS-Mg-DMF mixture was carefully transferred onto the beads with a wide orifice pipette tip. Samples were mixed by inverting the tubes approximately 10 times or until complete re-suspension of the beads. Samples were incubated at 55° C. for 10 minutes to tagment the DNA, then 15 μl of 4% SDS was added to each sample; samples were mixed by inverting the tubes and incubated at 55° C. for another 10 minutes to inactivate and strip Tn5 from DNA. Samples were then spun down for 30 seconds and placed on a magnetic stand. Supernatant was removed and beads were washed twice with WASH buffer and left stand in the second wash buffer till the Q5 polymerase PCR mix was prepared and ready to be transferred to all samples. Q5 High-Fidelity DNA Polymerase (M0491, New England BioLabs®) was used to amplify the haplotagged DNA bound to the beads using 4 µl of 10 µM PCR primers, TruSeq-F and TruSeq-R (SEQ ID NOs: 13 and 14), in a 50 µl reaction according to manufacturer's instructions, with the following cycling conditions: 5 min at 72° C., 30 sec 98° C. and 13 cycles of: 98° C. for 15 sec, 65° C. for 20 sec and 72° C. for 60 sec. Individual libraries were size selected using Ampure magnetic beads (#A63881, Beckman Coulter) for 300-600 bp fragment size, pooled at equimolar ratios and the final 4-plex library pool was Ampure bead cleaned/concentrated with 1:1 bead:sample ratio.

Sequencing and Demultiplexing

Pooled libraries were sequenced by a HiSeq 3000 (Illumina®) at the Genome Core Facility at the MPI Tübingen Campus with a 150+12+13+150 cycle run setting, such that the run produced 12 and 13 nt in the i7 and i5 index reads, respectively. Sequence data were first converted into fastq format using bcl2fastq v2.17.1.14 with the following parameters —use-bases-mask=Y150,Y12,17Y6,Y150 —minimum-trimmed-readlength=1 —mask-short-adapter-reads=1 —create-fastq-for-index-reads—barcode-mismatches=0 (Illumina®; and where applicable, demultiplexed by input samples by the "C" or "D" segments of the beadTag barcode). Then we performed beadTag assignment and generate the modified fastq files using our custom programmes filterFastq_by_bc (see Appendix I & II, below for details).

Appendix I—Algorithm for Demultiplexing

Input: The barcode white lists bclist_A, bclist_B, bclist_C and bclist_D for the barcodes A, B, C and D
The Illumina® Base Call files
<optional> the sample sheet
Output: The fastq files for R1 and R2 containing the barcode tag for each read
Step 1: Demultiplex the Illumina® Base Call files using bcl2fastq with R1 and R2 of length 150 bp, I7 of length 12 bp and 15 of length 13 bp where:
barcode A: 17 [7 . . . 11]
barcode B: 15 [7 . . . 12]
barcode C: 17 [0 . . . 5]
barcode D: 15 [0 . . . 5]
and different samples are separated when a sample sheet is provided for a specific barcode
Step 2: Construct the fastq files for R1 and R2 containing the reads for which all the 4 barcodes (A, B, C and D) are in the respective white list or they can be corrected without any ambiguity.
The first line of every fastq entry contains the sequence identifier followed by the tag:

```
BX:Z:A[0..9][0..9]B[0..9][0..9]C[0..9][0..9]D[0..9][0..9]
for each read pair r do
seqA←get_sequence_of_A(r,I7)
if seqA in bclist_A or can_be_corrected(seqA,bclist_A)
then
codeA← get_index_of_A(seqA,bclist_A)
end if
seqB←get_sequence_of_B(r,I5)
if seqB in bclist_B or can_be_corrected(seqB,bclist_B)
then
codeB ← get_index_of_B(seqB,bclist_B)
end if
seqC←get_sequence_of_C(r,I7)
```

-continued

```
if seqC in bclist_C or can_be_corrected(seqC,bclist_C)
then
codeC ← get_index_of_C(seqC,bclist_C)
end if
seqD←get_sequence_of_D(r,I5)
if seqD in bclist_D or can_be_corrected(seqD,bclist_D)
then
codeD ← get_index_of_D(seqD,bclist_D)
end if
if codeA != Null and codeB != Null and codeC != Null and
codeD != Null then
output read pair r with sequence identifier followed by the barcode tag:
"BX:Z:A"+ codeA+"B"+ codeB+"C"+ codeC+"D"+ codeD
end if
end for
```

Appendix II—Algorithm of Barcode Correction

Input: The sequence seqBC of a barcode which does not appear in the corresponding white list The white list bc_white_list of the barcode
<optional> The minimum distance threshold min_dist_threshold for a barcode to be corrected

```
Output: True if the barcode sequence seqBC
can be corrected without any ambiguity and
seqBC is modified to that correct barcode sequence
False if seqBC can be corrected into multiple white list barcodes boolean
can_be_corrected(seqBC, bc_white_list)
min_distance← 6
for each barcode b in bc_white_list do
distance← levenshtein_distance(seqBC,b)
if min_distance > distance then
min_distance← distance
nb_occurences←1
corrected_seqBC←b
else if min_distance = distance then
nb_occurences←nb_occurences + 1
end if
end for
if min_distance <= min_dist_threshold and nb_occureces =
1 then
seqBC← corrected_seqBC
return True
else
return False
end if
```

The application text above refers to the following tables and the corresponding description thereof.

TABLE 1

| i5 primer | i7 primer | | | |
|---|---|---|---|---|
| Barcode | A1C1 | A2C2 | A3C3 | A4C4 |
| B1D1 | 1.000 | 0.062 | 0.036 | 0.030 |
| B2D2 | 0.016 | 1.000 | 0.018 | 0.017 |
| B3D3 | 0.034 | 0.084 | 1.000 | 0.034 |
| B4D4 | 0.033 | 0.077 | 0.042 | 1.000 |

| | Length | Single segment (with error correction) |
|---|---|---|
| | 3 nt | 4 |
| | 4 nt | 12 |
| | 5 nt | 48 |
| | 6 nt | 84* |
| | 7 nt | 278 |
| | 8 nt | 727 |
| | 9 nt | 2620 |

TABLE 2

Exemplary error-correcting barcode diversity as a function of barcode length

| | 6 nt barcodes (full set of 96) | | | 6 nt barcodes (first 84) | | |
|---|---|---|---|---|---|---|
| Description | Hamming | SeqLev | Levenshtein | Hamming | SeqLev | Levenshtein |
| Mean distance | 4.54 | 3.19 | 4.08 | 4.54 | 3.19 | 4.08 |
| Median distance | 5 | 3 | 4 | 5 | 3 | 4 |
| Minimum distance | 2 | 1 | 2 | 3 | 1 | 2 |
| Maximum distance | 6 | 6 | 6 | 6 | 6 | 6 |
| Guaranteed error correction | 0 | 0 | 0 | 1 | 0 | 0 |
| Guaranteed error detection | 1 | 0 | 1 | 2 | 0 | 1 |

Therefore the practical solution for the lowest cost configuration would be to synthesize 4 segments of 6 nt or 7 nt barcodes, such that together they make up 12 and 13 cycles of i5 and i7 index reads.

TABLE 3

Characteristics for robust 6 nt barcode designs.

| Position | Nucleotide | Reads | % |
|---|---|---|---|
| X | A | 1,876,514 | 1 |
| | C | 2,087,865 | 1 |
| | T | 286,376,738 | 97 |
| | G | 5,876,938 | 2 |
| | N | 219 | 0 |
| Y | A | 1,787,678 | 1 |
| | C | 1,117,034 | 0 |
| | T | 3,703,830 | 1 |
| | G | 289,608,830 | 98 |
| | N | 902 | 0 |

TABLE 4

Error rate estimates.

| Barcode length | Error-free % | 1 mismatch % | Remarks |
|---|---|---|---|
| 1 | 97 | 100% | |
| 2 | 93 | 99.9% | |
| 3 | 90 | 99.7% | |
| 4 | 87 | 99.4% | |
| 5 | 84 | 99.0% | |
| 6 | 82 | 98.5% | beadTag A + |
| | | | B + C + D: |
| | | | $(98.5\%)^4 = 94.1\%$ |
| 12 | 67 | 94.2% | |
| 24 | 44 | 81.1% | |

TABLE 5

Segmental barcode correction enables high
demultiplexing success despite sequencing error.

| Haplotype | Statistics | | % | % of total |
|---|---|---|---|---|
| Reference, | Number of molecules | 856,839 | 100 | 51.1 |
| "0" | fully concordant molecules | 849,738 | 99.2 | |
| | molecules with 1 discordant SNP | 7,101 | 0.83 | |
| | Mean reads per mol. | 4.66 | | |
| | Median | 16.6 kbp | | |
| | $N_{50}$ | 38.3 kbp | | |
| | Longest | 200.2 kbp | | |
| Alternate, | Number of molecules | 819,256 | | 48.9 |
| "1" | fully concordant molecules | 815,427 | 99.5 | |
| | molecules with 1 discordant SNP | 3,829 | 0.47 | |
| | Mean reads per mol. | 4.63 | | |
| | Median | 16.5 kbp | | |
| | $N_{50}$ | 38.3 kbp | | |
| | Longest | 181.3 kbp | | |
| Mixed | Number of molecules | 836 | | 0.05 |
| | Mean reads per mol. | 6.52 | | |
| | Median | 32.3 kbp | | |
| | $N_{50}$ | 54.7 kbp | | |
| | Longest | 179.8 kbp | | |

TABLE 6

Summary statistics of haplotagging in F1 (BL6 × CAST) hybrid mouse sample. Across the genome the sequencing data showed even coverage of both the BL6 reference and the CAST alternate haplotypes. Virtually all of these molecules show complete concordance across their overlapping SNP positions. Several relevant summary statistics are shown here, highlighting the long-range information content of haplotagging: molecules span a much greater range than is otherwise achievable with classical paired-end sequencing. These results are largely comparable to other commercially available long-read or linked read technology, but achieved at a fraction of the library preparation cost, and take advantage of the low error rate and high throughput of Illumina sequencing machines, without customization. At the current stage such data is already sufficient to support long-range phasing and genome-wide haplotyping experiments. It is anticipated that with further optimization these parameters will show further improvements. Percentages may appear to add up to over 100% due to rounding errors.

|  | Illumina TruS eq (commercial provider A) | Illumina Nextera/Tn5 (in-house) | 10X Chromium (in-house) | Haplotagging |
|---|---|---|---|---|
| DNA extraction |  | 0.53 € | 0.53 € | 0.53 € |
| DNA normalization and size selection | 2.6 € | 0.26 € | 0.26 € | 0.26 € |
| Library generation | 13.5 € | 0.73 € | 210.8 € | 0.73 € |
| Total | 16.1 € | 1.52 € | 212 € | 1.52 € |

25

TABLE 7

Example sequencing library preparation costs. Listed above are representative consumables-only operating costs from a genome core facility for making sequencing-ready libraries from tissue biopsies, excluding one-time costs, which vary greatly across the library types. A key comparison here is that the sequencing library preparation costs for haplotagging is only a fraction of that of 10X Chromium, yet it yields comparable, if not superior results. For haplotagging, the major one-time costs are purchasing the oligonucleotides listed in the sequence listing (SEQ ID NO: 73 to 1992) and bead assembly, which may cost a total of 14,000 € for 1.4 billion beadTags. However, a single such order will deliver enough oligonucleotides for >20,000 libraries, bringing the per-sample costs down to ~0.7 € per sample.

| Sample | NA12878a | GM12878 | Fl(BL6 × CAST) | N2(BL6 × CAST)* |
|---|---|---|---|---|
| Species | Human | Human | Mouse | Mouse |
| Platform | CPTv2, one-tube | Haplotagging | Haplotagging | Haplotagging |
| Barcodes (M) | 0.147 | 1.701 | 1.130 | 2.232 |
| Read length | 2 × 76 | 2 × 150 | 2 × 150 | 2 × 150 |
| Number of read-pairs (millions) | 648 | 276.09 | 110.56 | 285.96 |
| Mapped bases (Gb)/Mapped % | 73/75% | 75.86/96% | 31.04/96% | 80.47/94% |
| Uniqueness %/Duplicates % | 79%/21% | 41%/59% | 74%/36% | 75%/25% |
| Mean depth of coverage (duplicates removed) | 19.2 | 9.73 | 7.49 | 59.64* |
| Mean DNA/barcode | 6 | 1.58 | 1.77 | 1.05 |
| Informative linked reads N50 (kb) | 58.5 | 41.79 | 38.53 | 55.98 |
| Mean reads/molecule | 5 | 10.11 | 6.34 | 6.71 |
| N50/max. molecule size | 34.9/339 | 63.47/573 | 42.22/415 | 40.87/281 |
| hetSNPs phased (%) | 98% | 98.59% | 99.69% | 99.910% |
| Phasing block N50 (Mb) | 1.14 | 1.08 | 10.93 | 14.45 |
| Longest phasing | 3.46 | 6.83 | 61.46 | 58.72 |
| Short switch error rate (%) | 0.13% | 0.95% | 0.056% | 0.075% |
| Long switch error rate (%) | 0.0085% | 0.039% | 0.024% | 0.014% |

*Only including data from heterozygous segments in backcross individual.

TABLE 8

Summary results from phasing using haplotagging, compared to CPTv2-seq as reported in Zhang et al., 2017, loc. cit.). Note that the reported mapped bases and other summary statistics from the GM12878 samples correspond to trimmed sequences and are slightly below the raw output metrics as cited in Examples 10 and 11. Note also that a larger dataset was used here for the F1 (BL6 × CAST) sample than the initial analysis described in Example 8, resulting in more reads and a higher mapped read number. Key performance metric in phasing perfoiniances are the proportion of heterozygous SNPs phased (hetSNPs phased); the size of the phase blocks, as indicated by the longest block and the metric N50 (the length of the block that exceeds 50% of the summed length of all blocks); and two estimates of switch errors: short switch errors that affect single SNPs, or long switch errors that suggest a recombinant molecule between the maternal and the paternal chromosomes. For many of these metrics, including mean reads per molecules, fraction of heterozygous SNPs phased, N50 molecule size, phasing block N50, longest phasing blocks, haplotagging delivered higher performance metrics than CPTv2-seq. This was achieved largely with lower coverage. The higher barcode diversity has also led to a mean of around 1 DNA per barcode, compared to 6 for CPTv2-seq. The N50 molecule size reported here for the F1 (BL6 × CAST) reflect the combined total N50 from the REF, ALT and MIX classes, and included additional data not analyzed in Example 8, resulting in slight differences in reported sizes (38.53 vs. 38.3 kbp).

While aspects of the invention are illustrated and described in detail in the Figures and in the foregoing description, such Figures and description are to be considered illustrative or exemplary and not restrictive. Also reference signs in the claims should not be construed as limiting the scope.

It will also be understood that changes and modifications may be made by those of ordinary skill within the scope and spirit of the claims. In particular, the present invention covers further embodiments with any combination of features from different embodiments described above. It is also to be noted in this context that the invention covers all further features shown in the figures individually, although they may not have been described in the previous or following description. Also, single alternatives of the embodiments described in the figures and the description and single alternatives of features thereof can be disclaimed from the subject matter according to aspects of the invention.

Whenever the word "comprising" is used in the claims, it should not be construed to exclude other elements or steps. Similarly, the indefinite article "a" or "an" does not exclude a plurality. It should also be understood that the terms "essentially", "substantially", "about", "approximately" and the like used in connection with an attribute or a value may define the attribute or the value in an exact manner in the context of the present disclosure. The terms "essentially", "substantially", "about", "approximately" and the like could thus also be omitted when referring to the respective attribute or value. The terms "essentially", "substantially", "about", "approximately" when used with a value may mean the value+10%, preferably +5%.

As used herein, common abbreviations are defined as follows:

A (when referring to a single nucleotide): Adenine and/or its nucleotide derivative(s)

ALT Non-identical nucleotide(s) according to the reference genome assembly

BL6 Laboratory mouse (*Mus musculus*) strains C57BL/6N or C57BL/6J of species bp basepair(s)

C (when referring to a single nucleotide): Cytosine and/or its nucleotide derivative(s)

° C. Temperature in degrees Centigrade

CAST Laboratory mouse (*Mus castaneus*) strain CAST/EiJ dATP Deoxyadenosine triphosphate dCTP Deoxycytidine triphosphate dGTP Deoxyguanosine triphosphate dITP Deoxyinosine triphosphate DNA Deoxyribose nucleic acid DMF N,N-dimethylformamide DMSO Dimethylsulfoxide dNTP Deoxynucleotide triphosphate dsDNA double-stranded DNA DTT Dithiothreitol dTTP Deoxythymidine triphosphate EDTA Ethylenediaminetetraacetic acid F1 First filial generation offspring g Gram(s)

G Guanosine and/or its nucleotide derivative(s)

gbp Gigabasepair(s)

gDNA genomic DNA

Glu Glutamic acid h or hr Hour(s)

HEPES-KOH 4-(2-Hydroxyethyl) piperazine-1-ethane-sulfonic acid potassium salt, N-(2-Hydroxyethyl) piperazine-N'-(2-ethanesulfonic acid) potassium salt HMW High molecular weight I (when referring to a single nucleotide): Inosine and/or its nucleotide derivative(s)

IPTG isopropyl β-D-1-thiogalactopyranoside kDa Kilodalton(s)

kbp Kilobasepair(s)

Leu Leucine

Lys Lysine

M Molar(s)

mbp Megabasepair(s)

mL Milliliter(s)

MgCl$_2$ Magnesium chloride mM Millimolar(s)

N Any nucleotide

NaCl Sodium chloride ng Nanogram(s)

nM Nanomolar(s)

nl Nanoliter(s)

nt nucleotide(s)

ø Diameter

PCR Polymerase chain reaction or thermocycling for amplification of DNA

% Percent pg Picogram(s)

Pro Proline qPCR quantitative PCR

REF Identical nucleotide(s) according to the reference genome assembly r.p.m. Revolutions per minute
r.t. Room temperature
s or sec Seconds
SBB Streptavidin binding buffer
SDS Sodium dodecyl sulfate
ssDNA single-stranded DNA
T Thymine or thymidine and/or its nucleotide derivative
(s)

TAPS [tris(hydroxymethyl)methylamino]propanesulfonic acid
Tris Tris(hydroxymethyl)aminomethane
Triton-X 100 Polyethylene glycol p-(1,1,3,3-tetramethyl-butyl)-phenyl ether
U unit of protein according to activity
μg or µg Microgram(s)
μl or µl or μL or µl Microliter(s)

---

SEQUENCE LISTING (2039 sequences)

SEQ ID NO: 1 - DNA, 70 bp, Artificial Sequence
  Nextera_adapter_Tn5A_P5
aatgatacggcgaccaccgagatctacactagatcgctcgtcggcagcgtcagatgtgtataagagacag

SEQ ID NO: 2 - DNA, 66 bp, Artificial Sequence
  Nextera_adapter_Tn5B_P7
caagcagaagacggcatacgagattcgccttagtctcgtgggctcggagatgtgtataagagacag

SEQ ID NO: 3 - DNA, 29 bp, Artificial Sequence
  P5 primer
  modified_base 23: /mod_base="OTHER" /note="deoxyuridine"
aatgatacggcgaccaccgaganctacac

SEQ ID NO: 4 - DNA, 24 bp, Artificial Sequence
  P7 primer
caagcagaagacggcatacgagat

SEQ ID NO: 5 - DNA, 33 bp, Artificial Sequence
  Read 1 sequencing primer
tcgtcggcagcgtcagatgtgtataagagacag

SEQ ID NO: 6 - DNA, 24 bp, Artificial Sequence
  i7 index sequencing primer
caagcagaagacggcatacgagat

SEQ ID NO: 7 - DNA, 29 bp, Artificial Sequence
  i5 index sequencing primer
aatgatacggcgaccaccgagatctacac

SEQ ID NO: 8 - DNA, 34 bp, Artificial Sequence
  Read 2 sequencing primer
gtctcgtgggctcggagatgtgtataagagacag

SEQ ID NO: 9 - DNA, 33 bp, Artificial Sequence; identical to SEQ ID NO: 5
  Tn5ME-A

SEQ ID NO: 10 - DNA, 34 bp, Artificial Sequence; identical to SEQ ID NO: 8
  Tn5ME-B

SEQ ID NO: 11 - DNA, 19 bp, Artificial Sequence
  Tn5MErev
  modified_base 1: /mod_base="OTHER" /note="5'-phosphorylation"
ctgtctcttatacacatct

SEQ ID NO: 12 - protein, 476 aa, Artificial Sequence
  Tn5 hyperactive mutant
  VARIANT 54: E54K
  VARIANT 372: L372P
MITSALHRAADWAKSVFSSAALGDPRRTARLVNVAAQLAKYSGKSITISSEGSKAMQEGAYRFIRNPNVSAEAIRKAGAMQTVKLAQEFPELLAIEDTTSLSYRHQVAEELGKLGSIQDKSRGWWVHSVLLLEATTFRTVGLLHQEWWMRPDDPADADEKESGKWLAAAATSRLRMGSMMSNVIAVCDREADIHAYLQDKLAHNERFVVRSKHPRKDVESGLYLYDHLKNQPELGGYQISIPQKGVVDKRGKRKNRPARKASLSLRSGRITLKQGNITLNAVLAEEINPPKGETPLKWLLLTSEPVESLAQALRVIDIYTHRWRIEEFHKAWKTGAGAERQRMEEPDNLERMVSILSFVAVRLLQLRESFTPPQALRAQGLLKEAEHVESQSAETVLTPDECQLLGYLDKGKRKRKEKAGSLQWAYMAIARLGGFMDSKRTGIASWGALWEGWEALQSKLDGFLAAKDLMAQGIKI

SEQ ID NO: 13 - DNA, 29 bp, Artificial Sequence
  TruSeq-F
aatgatacggcgaccaccgagatctacac

SEQ ID NO: 14 - DNA, 24 bp, Artificial Sequence
  TruSeq-R
caagcagaagacggcatacgagat

SEQ ID NO: 15 - DNA, 90 bp, Artificial Sequence
  i7biot_CGTaaGCT-complete
  modified_base 1: /mod_base="OTHER" /note="5'-biotinylation"
ttttttttttttttttttttttttttttcagaagacggcatacgagatcgtaagctgtctcgtgggctcggagatgtgtataagagacag

SEQ ID NO: 16 - DNA, 90 bp, Artificial Sequence
  i5biot_TAGccATC-complete
  modified_base 1: /mod_base="OTHER" /note="5'-biotinylation"
ttttttttttttttttttttttttttttttcgaccaccgagatctacactagccatctcgtcggcagcgtcagatgtgtataagagacag

SEQ ID NO: 17 - DNA, 58 bp, Artificial Sequence
  i7-biot-N701_TCG
  modified_base 1: /mod_base="OTHER" /note="5'-biotinylation"
tttttttttttttttttttttttttttttttttttcagaagacggcatacgagattcg

SEQ ID NO: 18 - DNA, 58 bp, Artificial Sequence
  i7-biot-N702_CTA
  modified_base 1: /mod_base="OTHER" /note="5'-biotinylation"
tttttttttttttttttttttttttttttttttttcagaagacggcatacgagatcta

SEQ ID NO: 19 - DNA, 58 bp, Artificial Sequence
  i7-biot-N703_TTC
  modified_base 1: /mod_base="OTHER" /note="5'-biotinylation"
tttttttttttttttttttttttttttttttttttcagaagacggcatacgagatttc

SEQ ID NO: 20 - DNA, 58 bp, Artificial Sequence
  i7-biot-N704_GCT
  modified_base 1: /mod_base="OTHER" /note="5'-biotinylation"
tttttttttttttttttttttttttttttttttttcagaagacggcatacgagatgct

SEQ ID NO: 21 - DNA, 25 bp, Artificial Sequence
  i7-Bot-N701_TCG-TT
ttcgaatctcgtatgccgtcttctg

SEQ ID NO: 22 - DNA, 25 bp, Artificial Sequence
  i7-Bot-N702_CTA-TT
tttagatctcgtatgccgtcttctg

SEQ ID NO: 23 - DNA, 25 bp, Artificial Sequence
  i7-Bot-N703_TTC-TT
ttgaaatctcgtatgccgtcttctg

SEQ ID NO: 24 - DNA, 25 bp, Artificial Sequence
  i7-Bot-N704_GCT-TT
ttagcatctcgtatgccgtcttctg

SEQ ID NO: 25 - DNA, 57 bp, Artificial Sequence
  i5-biot-N501_TAG
  modified_base 1: /mod_base="OTHER" /note="5'-biotinylation"
tttttttttttttttttttttttttttttttttttcgaccaccgagatctacactag

SEQ ID NO: 26 - DNA, 57 bp, Artificial Sequence
  i5-biot-N502_CTC
  modified_base 1: /mod_base="OTHER" /note="5'-biotinylation"
tttttttttttttttttttttttttttttttttttcgaccaccgagatctacacctc

SEQ ID NO: 27 - DNA, 57 bp, Artificial Sequence
  i5-biot-N503_TAT
  modified_base 1: /mod_base="OTHER" /note="5'-biotinylation"
tttttttttttttttttttttttttttttttttttcgaccaccgagatctacactat

SEQ ID NO: 28 - DNA, 57 bp, Artificial Sequence
  i5-biot-N504_AGA
  modified_base 1: /mod_base="OTHER" /note="5'-biotinylation"
tttttttttttttttttttttttttttttttttttcgaccaccgagatctacacaga

SEQ ID NO: 29 - DNA, 24 bp, Artificial Sequence
  i5-Bot-N501_TAG-CC
ccctagtgtagatctcggtggtcg

SEQ ID NO: 30 - DNA, 24 bp, Artificial Sequence
  i5-Bot-N502_CTC-CC
ccgaggtgtagatctcggtggtcg

SEQ ID NO: 31 - DNA, 24 bp, Artificial Sequence
  i5-Bot-N503_TAT-CC
ccatagtgtagatctcggtggtcg

SEQ ID NO: 32 - DNA, 24 bp, Artificial Sequence
  i5-Bot-N504_AGA-CC
cctctgtgtagatctcggtggtcg

SEQ ID NO: 33 - DNA, 39 bp, Artificial Sequence
  i7-Tn5Top-N701_CCT-AA
  modified_base 1: /mod_base="OTHER" /note="5'-phosphorylation"
aacctgtctcgtgggctcggagatgtgtataagagacag

SEQ ID NO: 34 - DNA, 39 bp, Artificial Sequence
  i7-Tn5Top-N702_GTA-AA
  modified_base 1: /mod_base="OTHER" /note="5'-phosphorylation"
aagtagtctcgtgggctcggagatgtgtataagagacag

SEQ ID NO: 35 - DNA, 39 bp, Artificial Sequence
  i7-Tn5Top-N703_TGC-AA
  modified_base 1: /mod_base="OTHER" /note="5'-phosphorylation"
aatgcgtctcgtgggctcggagatgtgtataagagacag

SEQ ID NO: 36 - DNA, 39 bp, Artificial Sequence
  i7-Tn5Top-N704_CAG-AA
  modified_base 1: /mod_base="OTHER" /note="5'-phosphorylation"
aacaggtctcgtgggctcggagatgtgtataagagacag

SEQ ID NO: 37 - DNA, 39 bp, Artificial Sequence
  i7-Tn5Top-N705_AGT-AA
  modified_base 1: /mod_base="OTHER" /note="5'-phosphorylation"
aaagtgtctcgtgggctcggagatgtgtataagagacag

SEQ ID NO: 38 - DNA, 39 bp, Artificial Sequence
  i7-Tn5Top-N706_GCC-AA
  modified_base 1: /mod_base="OTHER" /note="5'-phosphorylation"
aagccgtctcgtgggctcggagatgtgtataagagacag

SEQ ID NO: 39 - DNA, 39 bp, Artificial Sequence
  i7-Tn5Top-N707_GAG-AA
  modified_base 1: /mod_base="OTHER" /note="5'-phosphorylation"
aagaggtctcgtgggctcggagatgtgtataagagacag

SEQ ID NO: 40 - DNA, 39 bp, Artificial Sequence
  i7-Tn5Top-N708_CTC-AA
  modified_base 1: /mod_base="OTHER" /note="5'-phosphorylation"
aactcgtctcgtgggctcggagatgtgtataagagacag

SEQ ID NO: 41 - DNA, 37 bp, Artificial Sequence
  i7-Tn5Bot-N701_CCT
ctgtctcttatacacatctccgagcccacgagacagg

SEQ ID NO: 42 - DNA, 37 bp, Artificial Sequence
  i7-Tn5Bot-N702_GTA
ctgtctcttatacacatctccgagcccacgagactac

SEQ ID NO: 43 - DNA, 37 bp, Artificial Sequence
  i7-Tn5Bot-N703_TGC
ctgtctcttatacacatctccgagcccacgagacgca

SEQ ID NO: 44 - DNA, 37 bp, Artificial Sequence
  i7-Tn5Bot-N704_CAG
ctgtctcttatacacatctccgagcccacgagacctg

SEQ ID NO: 45 - DNA, 37 bp, Artificial Sequence
  i7-Tn5Bot-N705_AGT
ctgtctcttatacacatctccgagcccacgagacact

SEQ ID NO: 46 - DNA, 37 bp, Artificial Sequence
  i7-Tn5Bot-N706_GCC
ctgtctcttatacacatctccgagcccacgagacggc

SEQ ID NO: 47 - DNA, 37 bp, Artificial Sequence
  i7-Tn5Bot-N707_GAG
ctgtctcttatacacatctccgagcccacgagacctc

SEQ ID NO: 48 - DNA, 37 bp, Artificial Sequence
  i7-Tn5Bot-N708_CTC
ctgtctcttatacacatctccgagcccacgagacgag

SEQ ID NO: 49 - DNA, 38 bp, Artificial Sequence
  i5-Tn5Top-N501_ATC-GG
  modified_base 1: /mod_base="OTHER" /note="5'-phosphorylation"
ggatctcgtcggcagcgtcagatgtgtataagagacag

SEQ ID NO: 50 - DNA, 38 bp, Artificial Sequence
  i5-Tn5Top-N502_TCT-GG
  modified_base 1: /mod_base="OTHER" /note="5'-phosphorylation"
ggtcttcgtcggcagcgtcagatgtgtataagagacag

SEQ ID NO: 51 - DNA, 38 bp, Artificial Sequence
  i5-Tn5Top-N503_CCT-GG
  modified_base 1: /mod_base="OTHER" /note="5'-phosphorylation"
ggccttcgtcggcagcgtcagatgtgtataagagacag

SEQ ID NO: 52 - DNA, 38 bp, Artificial Sequence
  i5-Tn5Top-N504_GTA-GG
  modified_base 1: /mod_base="OTHER" /note="5'-phosphorylation"
gggtatcgtcggcagcgtcagatgtgtataagagacag

SEQ ID NO: 53 - DNA, 38 bp, Artificial Sequence
  i5-Tn5Top-N505_AGG-GG
  modified_base 1: /mod_base="OTHER" /note="5'-phosphorylation"
ggaggtcgtcggcagcgtcagatgtgtataagagacag

SEQ ID NO: 54 - DNA, 38 bp, Artificial Sequence
  i5-Tn5Top-N506_GCA-GG
  modified_base 1: /mod_base="OTHER" /note="5'-phosphorylation"
gggcatcgtcggcagcgtcagatgtgtataagagacag

SEQ ID NO: 55 - DNA, 38 bp, Artificial Sequence
  i5-Tn5Top-N507_GAG-GG
  modified_base 1: /mod_base="OTHER" /note="5'-phosphorylation"
gggagtcgtcggcagcgtcagatgtgtataagagacag

SEQ ID NO: 56 - DNA, 38 bp, Artificial Sequence
  i5-Tn5Top-N508_AGC-GG
  modified_base 1: /mod_base="OTHER" /note="5'-phosphorylation"
ggagctcgtcggcagcgtcagatgtgtataagagacag

SEQ ID NO: 57 - DNA, 36 bp, Artificial Sequence
  i5-Tn5Bot-N501_ATC
ctgtctcttatacacatctgacgctgccgacgagat

SEQ ID NO: 58 - DNA, 36 bp, Artificial Sequence
  i5-Tn5Bot-N502_TCT
ctgtctcttatacacatctgacgctgccgacgaaga

SEQ ID NO: 59 - DNA, 36 bp, Artificial Sequence
  i5-Tn5Bot-N503_CCT
ctgtctcttatacacatctgacgctgccgacgaagg

SEQ ID NO: 60 - DNA, 36 bp, Artificial Sequence
  i5-Tn5Bot-N504_GTA
ctgtctcttatacacatctgacgctgccgacgatac

SEQ ID NO: 61 - DNA, 36 bp, Artificial Sequence
  i5-Tn5Bot-N505_AGG
ctgtctcttatacacatctgacgctgccgacgacct

SEQ ID NO: 62 - DNA, 36 bp, Artificial Sequence
  i5-Tn5Bot-N506_GCA
ctgtctcttatacacatctgacgctgccgacgatgc

SEQ ID NO: 63 - DNA, 36 bp, Artificial Sequence
  i5-Tn5Bot-N507_GAG
ctgtctcttatacacatctgacgctgccgacgactc

SEQ ID NO: 64 - DNA, 36 bp, Artificial Sequence
  i5-Tn5Bot-N508_AGC
ctgtctcttatacacatctgacgctgccgacgagct

SEQ ID NO: 65 - DNA, 20 bp, Artificial Sequence
  A1C1
ggcatacgagattcgaacct

SEQ ID NO: 66 - DNA, 24 bp, Artificial Sequence
  A2C2
agacggcatacgagatctaaagta

SEQ ID NO: 67 - DNA, 23 bp, Artificial Sequence
  A3C3
gacggcatacgagatttcaatgc

SEQ ID NO: 68 - DNA, 21 bp, Artificial Sequence
  A4C4
cggcatacgagatgctaacag

SEQ ID NO: 69 - DNA, 22 bp, Artificial Sequence
  B1D1
accgagatctacactagggatc

SEQ ID NO: 70 - DNA, 20 bp, Artificial Sequence
  B2D2
cgagatctacacctcggtct

SEQ ID NO: 71 - DNA, 21 bp, Artificial Sequence
  B3D3
ccgagatctacactatggcct

SEQ ID NO: 72 - DNA, 21 bp, Artificial Sequence
  B4D4
ccgagatctacacagagggta

SEQ ID NO: 73 - DNA, 60 bp, Artificial Sequence
  AFor_1_TTTCCGT
  modified_base 1: /mod_base="OTHER" /note="5'-biotinylation"
ttttttttttttttttttttttttttttttttttcagaagacggcatacgagatttccgt

SEQ ID NO: 74 - DNA, 60 bp, Artificial Sequence
  AFor_2_TTGTTGG
  modified_base 1: /mod_base="OTHER" /note="5'-biotinylation"
ttttttttttttttttttttttttttttttttttcagaagacggcatacgagattgttgg

SEQ ID NO: 75 - DNA, 60 bp, Artificial Sequence
  AFor_3_TCGATCT
  modified_base 1: /mod_base="OTHER" /note="5'-biotinylation"
ttttttttttttttttttttttttttttttttttcagaagacggcatacgagatcgatct

SEQ ID NO: 76 - DNA, 60 bp, Artificial Sequence
  AFor_4_TGGAGAA
  modified_base 1: /mod_base="OTHER" /note="5'-biotinylation"
ttttttttttttttttttttttttttttttttttcagaagacggcatacgagatggagaa

SEQ ID NO: 77 - DNA, 60 bp, Artificial Sequence
  AFor_5_TCAGGAA
  modified_base 1: /mod_base="OTHER" /note="5'-biotinylation"
ttttttttttttttttttttttttttttttttttcagaagacggcatacgagatcaggaa

SEQ ID NO: 78 - DNA, 60 bp, Artificial Sequence
  AFor_6_TACCGAA
  modified_base 1: /mod_base="OTHER" /note="5'-biotinylation"
ttttttttttttttttttttttttttttttttttcagaagacggcatacgagataccgaa

SEQ ID NO: 79 - DNA, 60 bp, Artificial Sequence
  AFor_7_TCCACAA
  modified_base 1: /mod_base="OTHER" /note="5'-biotinylation"
ttttttttttttttttttttttttttttttttttcagaagacggcatacgagatccacaa

SEQ ID NO: 80 - DNA, 60 bp, Artificial Sequence
  AFor_8_TAGGCAA
  modified_base 1: /mod_base="OTHER" /note="5'-biotinylation"
ttttttttttttttttttttttttttttttttttcagaagacggcatacgagataggcaa

SEQ ID NO: 81 - DNA, 60 bp, Artificial Sequence
  AFor_9_TGACCAA
  modified_base 1: /mod_base="OTHER" /note="5'-biotinylation"
ttttttttttttttttttttttttttttttttttcagaagacggcatacgagatgaccaa

SEQ ID NO: 82 - DNA, 60 bp, Artificial Sequence
  AFor_10_TGCGTAA
  modified_base 1: /mod_base="OTHER" /note="5'-biotinylation"
ttttttttttttttttttttttttttttttttttcagaagacggcatacgagatgcgtaa

SEQ ID NO: 83 - DNA, 60 bp, Artificial Sequence
  AFor_11_TCGCTAA
  modified_base 1: /mod_base="OTHER" /note="5'-biotinylation"
ttttttttttttttttttttttttttttttttttcagaagacggcatacgagatcgctaa

SEQ ID NO: 84 - DNA, 60 bp, Artificial Sequence
  AFor_12_TCGAAGA
  modified_base 1: /mod_base="OTHER" /note="5'-biotinylation"
ttttttttttttttttttttttttttttttttttcagaagacggcatacgagatcgaaga

SEQ ID NO: 85 - DNA, 60 bp, Artificial Sequence
  AFor_13_TGAGAGA
  modified_base 1: /mod_base="OTHER" /note="5'-biotinylation"
ttttttttttttttttttttttttttttttttttcagaagacggcatacgagatgagaga

SEQ ID NO: 86 - DNA, 60 bp, Artificial Sequence
  AFor_14_TTCCAGA
  modified_base 1: /mod_base="OTHER" /note="5'-biotinylation"
ttttttttttttttttttttttttttttttttttcagaagacggcatacgagattccaga

SEQ ID NO: 87 - DNA, 60 bp, Artificial Sequence
  AFor_15_TAGTGGA
  modified_base 1: /mod_base="OTHER" /note="5'-biotinylation"
ttttttttttttttttttttttttttttttttttcagaagacggcatacgagatagtgga

SEQ ID NO: 88 - DNA, 60 bp, Artificial Sequence
  AFor_16_TGTACGA
  modified_base 1: /mod_base="OTHER" /note="5'-biotinylation"
ttttttttttttttttttttttttttttttttttcagaagacggcatacgagatgtacga

SEQ ID NO: 89 - DNA, 60 bp, Artificial Sequence
  AFor_17_TCATCGA
  modified_base 1: /mod_base="OTHER" /note="5'-biotinylation"
ttttttttttttttttttttttttttttttttttcagaagacggcatacgagatcatcga

SEQ ID NO: 90 - DNA, 60 bp, Artificial Sequence
  AFor_18_TCTGTGA
  modified_base 1: /mod_base="OTHER" /note="5'-biotinylation"
ttttttttttttttttttttttttttttttttttcagaagacggcatacgagatctgtga

SEQ ID NO: 91 - DNA, 60 bp, Artificial Sequence
  AFor_19_TGCAACA
  modified_base 1: /mod_base="OTHER" /note="5'-biotinylation"
ttttttttttttttttttttttttttttttttttcagaagacggcatacgagatgcaaca

SEQ ID NO: 92 - DNA, 60 bp, Artificial Sequence
  AFor_20_TTGGACA
  modified_base 1: /mod_base="OTHER" /note="5'-biotinylation"
ttttttttttttttttttttttttttttttttttcagaagacggcatacgagattggaca

SEQ ID NO: 93 - DNA, 60 bp, Artificial Sequence
  AFor_21_TCACACA
  modified_base 1: /mod_base="OTHER" /note="5'-biotinylation"
ttttttttttttttttttttttttttttttttttcagaagacggcatacgagatcacaca

SEQ ID NO: 94 - DNA, 60 bp, Artificial Sequence
  AFor_22_TCTAGCA
  modified_base 1: /mod_base="OTHER" /note="5'-biotinylation"
ttttttttttttttttttttttttttttttttttcagaagacggcatacgagatctagca

SEQ ID NO: 95 - DNA, 60 bp, Artificial Sequence
  AFor_23_TGATGCA
  modified_base 1: /mod_base="OTHER" /note="5'-biotinylation"
ttttttttttttttttttttttttttttttttttcagaagacggcatacgagatgatgca

SEQ ID NO: 96 - DNA, 60 bp, Artificial Sequence
  AFor_24_TACTCCA
  modified_base 1: /mod_base="OTHER" /note="5'-biotinylation"
ttttttttttttttttttttttttttttttttttcagaagacggcatacgagatactcca

SEQ ID NO: 97 - DNA, 60 bp, Artificial Sequence
  AFor_25_TGTCTCA
  modified_base 1: /mod_base="OTHER" /note="5'-biotinylation"
ttttttttttttttttttttttttttttttttttcagaagacggcatacgagatgtctca

SEQ ID NO: 98 - DNA, 60 bp, Artificial Sequence
  AFor_26_TCCGATA
  modified_base 1: /mod_base="OTHER" /note="5'-biotinylation"
ttttttttttttttttttttttttttttttttttcagaagacggcatacgagatccgata

SEQ ID NO: 99 - DNA, 60 bp, Artificial Sequence
  AFor_27_TGGCATA
  modified_base 1: /mod_base="OTHER" /note="5'-biotinylation"
ttttttttttttttttttttttttttttttttttcagaagacggcatacgagatggcata

SEQ ID NO: 100 - DNA, 60 bp, Artificial Sequence
  AFor_28_TGTGGTA
  modified_base 1: /mod_base="OTHER" /note="5'-biotinylation"
ttttttttttttttttttttttttttttttttttcagaagacggcatacgagatgtggta

SEQ ID NO: 101 - DNA, 60 bp, Artificial Sequence
  AFor_29_TCTCCTA
  modified_base 1: /mod_base="OTHER" /note="5'-biotinylation"
ttttttttttttttttttttttttttttttttttcagaagacggcatacgagatctccta

SEQ ID NO: 102 - DNA, 60 bp, Artificial Sequence
  AFor_30_TACGAAG
  modified_base 1: /mod_base="OTHER" /note="5'-biotinylation"
ttttttttttttttttttttttttttttttttttcagaagacggcatacgagatacgaag

SEQ ID NO: 103 - DNA, 60 bp, Artificial Sequence
  AFor_31_TTGCAAG
  modified_base 1: /mod_base="OTHER" /note="5'-biotinylation"
ttttttttttttttttttttttttttttttttttcagaagacggcatacgagattgcaag

SEQ ID NO: 104 - DNA, 60 bp, Artificial Sequence
  AFor_32_TTCAGAG
  modified_base 1: /mod_base="OTHER" /note="5'-biotinylation"
ttttttttttttttttttttttttttttttttttcagaagacggcatacgagattcagag

SEQ ID NO: 105 - DNA, 60 bp, Artificial Sequence
  AFor_33_TGTTGAG
  modified_base 1: /mod_base="OTHER" /note="5'-biotinylation"
ttttttttttttttttttttttttttttttttttcagaagacggcatacgagatgttgag

SEQ ID NO: 106 - DNA, 60 bp, Artificial Sequence
  AFor_34_TTAGCAG
  modified_base 1: /mod_base="OTHER" /note="5'-biotinylation"
ttttttttttttttttttttttttttttttttttcagaagacggcatacgagattagcag

SEQ ID NO: 107 - DNA, 60 bp, Artificial Sequence
  AFor_35_TATCCAG
  modified_base 1: /mod_base="OTHER" /note="5'-biotinylation"
ttttttttttttttttttttttttttttttttttcagaagacggcatacgagatatccag

SEQ ID NO: 108 - DNA, 60 bp, Artificial Sequence
  AFor_36_TCCTTAG
  modified_base 1: /mod_base="OTHER" /note="5'-biotinylation"
ttttttttttttttttttttttttttttttttttcagaagacggcatacgagatccttag

SEQ ID NO: 109 - DNA, 60 bp, Artificial Sequence
  AFor_37_TTTGAGG
  modified_base 1: /mod_base="OTHER" /note="5'-biotinylation"
ttttttttttttttttttttttttttttttttttcagaagacggcatacgagatttgagg

SEQ ID NO: 110 - DNA, 60 bp, Artificial Sequence
  AFor_38_TAACAGG
  modified_base 1: /mod_base="OTHER" /note="5'-biotinylation"
ttttttttttttttttttttttttttttttttttcagaagacggcatacgagataacagg

SEQ ID NO: 111 - DNA, 60 bp, Artificial Sequence
  AFor_39_TGAATGG
  modified_base 1: /mod_base="OTHER" /note="5'-biotinylation"
ttttttttttttttttttttttttttttttttttcagaagacggcatacgagatgaatgg

SEQ ID NO: 112 - DNA, 60 bp, Artificial Sequence
  AFor_40_TAGAACG
  modified_base 1: /mod_base="OTHER" /note="5'-biotinylation"
ttttttttttttttttttttttttttttttttttcagaagacggcatacgagatagaacg

SEQ ID NO: 113 - DNA, 60 bp, Artificial Sequence
  AFor_41_TTCTACG
  modified_base 1: /mod_base="OTHER" /note="5'-biotinylation"
ttttttttttttttttttttttttttttttttttcagaagacggcatacgagattctacg

SEQ ID NO: 114 - DNA, 60 bp, Artificial Sequence
  AFor_42_TTTACCG
  modified_base 1: /mod_base="OTHER" /note="5'-biotinylation"
ttttttttttttttttttttttttttttttttttcagaagacggcatacgagatttaccg

SEQ ID NO: 115 - DNA, 60 bp, Artificial Sequence
  AFor_43_TAAGTCG
  modified_base 1: /mod_base="OTHER" /note="5'-biotinylation"
ttttttttttttttttttttttttttttttttttcagaagacggcatacgagataagtcg

SEQ ID NO: 116 - DNA, 60 bp, Artificial Sequence
  AFor_44_TCGTATG
  modified_base 1: /mod_base="OTHER" /note="5'-biotinylation"
ttttttttttttttttttttttttttttttttttcagaagacggcatacgagatcgtatg

SEQ ID NO: 117 - DNA, 60 bp, Artificial Sequence
  AFor_45_TCAAGTG
  modified_base 1: /mod_base="OTHER" /note="5'-biotinylation"
ttttttttttttttttttttttttttttttttttcagaagacggcatacgagatcaagtg

SEQ ID NO: 118 - DNA, 60 bp, Artificial Sequence
  AFor_46_TTTCGTG
  modified_base 1: /mod_base="OTHER" /note="5'-biotinylation"
ttttttttttttttttttttttttttttttttttcagaagacggcatacgagatttcgtg

SEQ ID NO: 119 - DNA, 60 bp, Artificial Sequence
  AFor_47_TACTGTG
  modified_base 1: /mod_base="OTHER" /note="5'-biotinylation"
ttttttttttttttttttttttttttttttttttcagaagacggcatacgagatactgtg

SEQ ID NO: 120 - DNA, 60 bp, Artificial Sequence
  AFor_48_TGATCTG
  modified_base 1: /mod_base="OTHER" /note="5'-biotinylation"
ttttttttttttttttttttttttttttttttttcagaagacggcatacgagatgatctg

SEQ ID NO: 121 - DNA, 60 bp, Artificial Sequence
  AFor_49_TTCGTTG
  modified_base 1: /mod_base="OTHER" /note="5'-biotinylation"
ttttttttttttttttttttttttttttttttttcagaagacggcatacgagattcgttg

SEQ ID NO: 122 - DNA, 60 bp, Artificial Sequence
  AFor_50_TAGCTTG
  modified_base 1: /mod_base="OTHER" /note="5'-biotinylation"
ttttttttttttttttttttttttttttttttttcagaagacggcatacgagatagcttg

SEQ ID NO: 123 - DNA, 60 bp, Artificial Sequence
  AFor_51_TGTGAAC
  modified_base 1: /mod_base="OTHER" /note="5'-biotinylation"
ttttttttttttttttttttttttttttttttttcagaagacggcatacgagatgtgaac

SEQ ID NO: 124 - DNA, 60 bp, Artificial Sequence
  AFor_52_TTACGAC
  modified_base 1: /mod_base="OTHER" /note="5'-biotinylation"
ttttttttttttttttttttttttttttttttttcagaagacggcatacgagattacgac

SEQ ID NO: 125 - DNA, 60 bp, Artificial Sequence
  AFor_53_TTGACAC
  modified_base 1: /mod_base="OTHER" /note="5'-biotinylation"
ttttttttttttttttttttttttttttttttttcagaagacggcatacgagattgacac

SEQ ID NO: 126 - DNA, 60 bp, Artificial Sequence
  AFor_54_TCTTCAC
  modified_base 1: /mod_base="OTHER" /note="5'-biotinylation"
ttttttttttttttttttttttttttttttttttcagaagacggcatacgagatcttcac

SEQ ID NO: 127 - DNA, 60 bp, Artificial Sequence
  AFor_55_TGGTTAC
  modified_base 1: /mod_base="OTHER" /note="5'-biotinylation"
ttttttttttttttttttttttttttttttttttcagaagacggcatacgagatggttac

SEQ ID NO: 128 - DNA, 60 bp, Artificial Sequence
  AFor_56_TACAAGC
  modified_base 1: /mod_base="OTHER" /note="5'-biotinylation"
ttttttttttttttttttttttttttttttttttcagaagacggcatacgagatacaagc

SEQ ID NO: 129 - DNA, 60 bp, Artificial Sequence
  AFor_57_TTTAGGC
  modified_base 1: /mod_base="OTHER" /note="5'-biotinylation"
ttttttttttttttttttttttttttttttttttcagaagacggcatacgagatttaggc

SEQ ID NO: 130 - DNA, 60 bp, Artificial Sequence
  AFor_58_TTAGTGC
  modified_base 1: /mod_base="OTHER" /note="5'-biotinylation"
ttttttttttttttttttttttttttttttttttcagaagacggcatacgagattagtgc

SEQ ID NO: 131 - DNA, 60 bp, Artificial Sequence
  AFor_59_TATCTGC
  modified_base 1: /mod_base="OTHER" /note="5'-biotinylation"
ttttttttttttttttttttttttttttttttttcagaagacggcatacgagatatctgc

SEQ ID NO: 132 - DNA, 60 bp, Artificial Sequence
  AFor_60_TTTCACC
  modified_base 1: /mod_base="OTHER" /note="5'-biotinylation"
ttttttttttttttttttttttttttttttttttcagaagacggcatacgagatttcacc

SEQ ID NO: 133 - DNA, 60 bp, Artificial Sequence
  AFor_61_TATTGCC
  modified_base 1: /mod_base="OTHER" /note="5'-biotinylation"
ttttttttttttttttttttttttttttttttttcagaagacggcatacgagatattgcc

SEQ ID NO: 134 - DNA, 60 bp, Artificial Sequence
  AFor_62_TTCATCC
  modified_base 1: /mod_base="OTHER" /note="5'-biotinylation"
ttttttttttttttttttttttttttttttttttcagaagacggcatacgagattcatcc

SEQ ID NO: 135 - DNA, 60 bp, Artificial Sequence
  AFor_63_TCATTCC
  modified_base 1: /mod_base="OTHER" /note="5'-biotinylation"
ttttttttttttttttttttttttttttttttttcagaagacggcatacgagatcattcc

SEQ ID NO: 136 - DNA, 60 bp, Artificial Sequence
  AFor_64_TAGGATC
  modified_base 1: /mod_base="OTHER" /note="5'-biotinylation"
ttttttttttttttttttttttttttttttttttcagaagacggcatacgagataggatc

SEQ ID NO: 137 - DNA, 60 bp, Artificial Sequence
  AFor_65_TGCTATC
  modified_base 1: /mod_base="OTHER" /note="5'-biotinylation"
ttttttttttttttttttttttttttttttttttcagaagacggcatacgagatgctatc

SEQ ID NO: 138 - DNA, 60 bp, Artificial Sequence
  AFor_66_TTGTGTC
  modified_base 1: /mod_base="OTHER" /note="5'-biotinylation"
ttttttttttttttttttttttttttttttttttcagaagacggcatacgagattgtgtc

SEQ ID NO: 139 - DNA, 60 bp, Artificial Sequence
  AFor_67_TTTGCTC
  modified_base 1: /mod_base="OTHER" /note="5'-biotinylation"
ttttttttttttttttttttttttttttttttttcagaagacggcatacgagatttgctc

SEQ ID NO: 140 - DNA, 60 bp, Artificial Sequence
  AFor_68_TAACCTC
  modified_base 1: /mod_base="OTHER" /note="5'-biotinylation"
ttttttttttttttttttttttttttttttttttcagaagacggcatacgagataacctc

SEQ ID NO: 141 - DNA, 60 bp, Artificial Sequence
  AFor_69_TCGGAAT
  modified_base 1: /mod_base="OTHER" /note="5'-biotinylation"
ttttttttttttttttttttttttttttttttttcagaagacggcatacgagatcggaat

SEQ ID NO: 142 - DNA, 60 bp, Artificial Sequence
  AFor_70_TGCCAAT
  modified_base 1: /mod_base="OTHER" /note="5'-biotinylation"
ttttttttttttttttttttttttttttttttttcagaagacggcatacgagatgccaat

SEQ ID NO: 143 - DNA, 60 bp, Artificial Sequence
  AFor_71_TCTCGAT
  modified_base 1: /mod_base="OTHER" /note="5'-biotinylation"
ttttttttttttttttttttttttttttttttttcagaagacggcatacgagatctcgat

SEQ ID NO: 144 - DNA, 60 bp, Artificial Sequence
  AFor_72_TGGTAGT
  modified_base 1: /mod_base="OTHER" /note="5'-biotinylation"
ttttttttttttttttttttttttttttttttttcagaagacggcatacgagatggtagt

SEQ ID NO: 145 - DNA, 60 bp, Artificial Sequence
  AFor_73_TTCTGGT
  modified_base 1: /mod_base="OTHER" /note="5'-biotinylation"
ttttttttttttttttttttttttttttttttttcagaagacggcatacgagattctggt

SEQ ID NO: 146 - DNA, 60 bp, Artificial Sequence
  AFor_74_TAGACGT
  modified_base 1: /mod_base="OTHER" /note="5'-biotinylation"
ttttttttttttttttttttttttttttttttttcagaagacggcatacgagatagacgt

SEQ ID NO: 147 - DNA, 60 bp, Artificial Sequence
  AFor_75_TACGTGT
  modified_base 1: /mod_base="OTHER" /note="5'-biotinylation"
ttttttttttttttttttttttttttttttttttcagaagacggcatacgagatacgtgt

SEQ ID NO: 148 - DNA, 60 bp, Artificial Sequence
  AFor_76_TCACTGT
  modified_base 1: /mod_base="OTHER" /note="5'-biotinylation"
ttttttttttttttttttttttttttttttttttcagaagacggcatacgagatcactgt

SEQ ID NO: 149 - DNA, 60 bp, Artificial Sequence
  AFor_77_TACAGCT
  modified_base 1: /mod_base="OTHER" /note="5'-biotinylation"
ttttttttttttttttttttttttttttttttttcagaagacggcatacgagatacagct

SEQ ID NO: 150 - DNA, 60 bp, Artificial Sequence
  AFor_78_TTAGGCT
  modified_base 1: /mod_base="OTHER" /note="5'-biotinylation"
ttttttttttttttttttttttttttttttttttcagaagacggcatacgagattaggct

SEQ ID NO: 151 - DNA, 60 bp, Artificial Sequence
  AFor_79_TGAACCT
  modified_base 1: /mod_base="OTHER" /note="5'-biotinylation"
ttttttttttttttttttttttttttttttttttcagaagacggcatacgagatgaacct

SEQ ID NO: 152 - DNA, 60 bp, Artificial Sequence
  AFor_80_TATGCCT
  modified_base 1: /mod_base="OTHER" /note="5'-biotinylation"
ttttttttttttttttttttttttttttttttttcagaagacggcatacgagatatgcct

SEQ ID NO: 153 - DNA, 60 bp, Artificial Sequence
  AFor_81_TTGTCCT
  modified_base 1: /mod_base="OTHER" /note="5'-biotinylation"
ttttttttttttttttttttttttttttttttttcagaagacggcatacgagattgtcct

SEQ ID NO: 154 - DNA, 60 bp, Artificial Sequence
  AFor_82_TGCTTCT
  modified_base 1: /mod_base="OTHER" /note="5'-biotinylation"
ttttttttttttttttttttttttttttttttttcagaagacggcatacgagatgcttct

SEQ ID NO: 155 - DNA, 60 bp, Artificial Sequence
  AFor_83_TGACGTT
  modified_base 1: /mod_base="OTHER" /note="5'-biotinylation"
ttttttttttttttttttttttttttttttttttcagaagacggcatacgagatgacgtt

SEQ ID NO: 156 - DNA, 60 bp, Artificial Sequence
  AFor_84_TCAGCTT
  modified_base 1: /mod_base="OTHER" /note="5'-biotinylation"
ttttttttttttttttttttttttttttttttttcagaagacggcatacgagatcagctt

SEQ ID NO: 157 - DNA, 60 bp, Artificial Sequence
  AFor_85_TTACTCG
  modified_base 1: /mod_base="OTHER" /note="5'-biotinylation"
ttttttttttttttttttttttttttttttttttcagaagacggcatacgagattactcg

SEQ ID NO: 158 - DNA, 60 bp, Artificial Sequence
  AFor_86_TGGATTC
  modified_base 1: /mod_base="OTHER" /note="5'-biotinylation"
ttttttttttttttttttttttttttttttttttcagaagacggcatacgagatggattc

SEQ ID NO: 159 - DNA, 60 bp, Artificial Sequence
  AFor_87_TCCATTC
  modified_base 1: /mod_base="OTHER" /note="5'-biotinylation"
ttttttttttttttttttttttttttttttttttcagaagacggcatacgagatccattc

SEQ ID NO: 160 - DNA, 60 bp, Artificial Sequence
  AFor_88_TGCACTT
  modified_base 1: /mod_base="OTHER" /note="5'-biotinylation"
ttttttttttttttttttttttttttttttttttcagaagacggcatacgagatgcactt

SEQ ID NO: 161 - DNA, 60 bp, Artificial Sequence
  AFor_89_TCCTCTT
  modified_base 1: /mod_base="OTHER" /note="5'-biotinylation"
ttttttttttttttttttttttttttttttttttcagaagacggcatacgagatcctctt

SEQ ID NO: 162 - DNA, 60 bp, Artificial Sequence
  AFor_90_TCCTGTA
  modified_base 1: /mod_base="OTHER" /note="5'-biotinylation"
ttttttttttttttttttttttttttttttttttcagaagacggcatacgagatcctgta

SEQ ID NO: 163 - DNA, 60 bp, Artificial Sequence
  AFor_91_TAGTCAG
  modified_base 1: /mod_base="OTHER" /note="5'-biotinylation"
ttttttttttttttttttttttttttttttttttcagaagacggcatacgagatagtcag

SEQ ID NO: 164 - DNA, 60 bp, Artificial Sequence
  AFor_92_TGACTAG
  modified_base 1: /mod_base="OTHER" /note="5'-biotinylation"
ttttttttttttttttttttttttttttttttttcagaagacggcatacgagatgactag

SEQ ID NO: 165 - DNA, 60 bp, Artificial Sequence
  AFor_93_TCTTAGG
  modified_base 1: /mod_base="OTHER" /note="5'-biotinylation"
ttttttttttttttttttttttttttttttttttcagaagacggcatacgagatcttagg

SEQ ID NO: 166 - DNA, 60 bp, Artificial Sequence
  AFor_94_TCTATGG
  modified_base 1: /mod_base="OTHER" /note="5'-biotinylation"
ttttttttttttttttttttttttttttttttttcagaagacggcatacgagatctatgg

SEQ ID NO: 167 - DNA, 60 bp, Artificial Sequence
  AFor_95_TGTTACG
  modified_base 1: /mod_base="OTHER" /note="5'-biotinylation"
ttttttttttttttttttttttttttttttttttcagaagacggcatacgagatgttacg

SEQ ID NO: 168 - DNA, 60 bp, Artificial Sequence
  AFor_96_TGCATTG
  modified_base 1: /mod_base="OTHER" /note="5'-biotinylation"
ttttttttttttttttttttttttttttttttttcagaagacggcatacgagatgcattg

SEQ ID NO: 169 - DNA, 60 bp, Artificial Sequence
  BFor_1_TCCGTT
  modified_base 1: /mod_base="OTHER" /note="5'-biotinylation"
tttttttttttttttttttttttttttttttttttcgaccaccgagatctacactccgtt

SEQ ID NO: 170 - DNA, 60 bp, Artificial Sequence
  BFor_2_GTTGGT
  modified_base 1: /mod_base="OTHER" /note="5'-biotinylation"
tttttttttttttttttttttttttttttttttttcgaccaccgagatctacacgttggt

SEQ ID NO: 171 - DNA, 60 bp, Artificial Sequence
  BFor_3_GATCTC
  modified_base 1: /mod_base="OTHER" /note="5'-biotinylation"
tttttttttttttttttttttttttttttttttttcgaccaccgagatctacacgatctc

SEQ ID NO: 172 - DNA, 60 bp, Artificial Sequence
  BFor_4_GAGAAG
  modified_base 1: /mod_base="OTHER" /note="5'-biotinylation"
tttttttttttttttttttttttttttttttttttcgaccaccgagatctacacgagaag

SEQ ID NO: 173 - DNA, 60 bp, Artificial Sequence
  BFor_5_AGGAAC
  modified_base 1: /mod_base="OTHER" /note="5'-biotinylation"
tttttttttttttttttttttttttttttttttttcgaccaccgagatctacacaggaac

SEQ ID NO: 174 - DNA, 60 bp, Artificial Sequence
  BFor_6_CCGAAA
  modified_base 1: /mod_base="OTHER" /note="5'-biotinylation"
tttttttttttttttttttttttttttttttttttcgaccaccgagatctacacccgaaa

SEQ ID NO: 175 - DNA, 60 bp, Artificial Sequence
  BFor_7_CACAAC
  modified_base 1: /mod_base="OTHER" /note="5'-biotinylation"
tttttttttttttttttttttttttttttttttttcgaccaccgagatctacaccacaac

SEQ ID NO: 176 - DNA, 60 bp, Artificial Sequence
  BFor_8_GGCAAA
  modified_base 1: /mod_base="OTHER" /note="5'-biotinylation"
tttttttttttttttttttttttttttttttttttcgaccaccgagatctacacggcaaa

SEQ ID NO: 177 - DNA, 60 bp, Artificial Sequence
  BFor_9_ACCAAG
  modified_base 1: /mod_base="OTHER" /note="5'-biotinylation"
tttttttttttttttttttttttttttttttttttcgaccaccgagatctacacaccaag

SEQ ID NO: 178 - DNA, 60 bp, Artificial Sequence
  BFor_10_CGTAAG
  modified_base 1: /mod_base="OTHER" /note="5'-biotinylation"
tttttttttttttttttttttttttttttttttttcgaccaccgagatctacaccgtaag

SEQ ID NO: 179 - DNA, 60 bp, Artificial Sequence
  BFor_11_GCTAAC
  modified_base 1: /mod_base="OTHER" /note="5'-biotinylation"
tttttttttttttttttttttttttttttttttttcgaccaccgagatctacacgctaac

SEQ ID NO: 180 - DNA, 60 bp, Artificial Sequence
  BFor_12_GAAGAC
  modified_base 1: /mod_base="OTHER" /note="5'-biotinylation"
tttttttttttttttttttttttttttttttttttcgaccaccgagatctacacgaagac

SEQ ID NO: 181 - DNA, 60 bp, Artificial Sequence
  BFor_13_AGAGAG
  modified_base 1: /mod_base="OTHER" /note="5'-biotinylation"
tttttttttttttttttttttttttttttttttttcgaccaccgagatctacacagagag

SEQ ID NO: 182 - DNA, 60 bp, Artificial Sequence
  BFor_14_CCAGAT
  modified_base 1: /mod_base="OTHER" /note="5'-biotinylation"
tttttttttttttttttttttttttttttttttttcgaccaccgagatctacacccagat

SEQ ID NO: 183 - DNA, 60 bp, Artificial Sequence
  BFor_15_GTGGAA
  modified_base 1: /mod_base="OTHER" /note="5'-biotinylation"
tttttttttttttttttttttttttttttttttttcgaccaccgagatctacacgtggaa

SEQ ID NO: 184 - DNA, 60 bp, Artificial Sequence
  BFor_16_TACGAG
  modified_base 1: /mod_base="OTHER" /note="5'-biotinylation"
tttttttttttttttttttttttttttttttttttcgaccaccgagatctacactacgag

SEQ ID NO: 185 - DNA, 60 bp, Artificial Sequence
  BFor_17_ATCGAC
  modified_base 1: /mod_base="OTHER" /note="5'-biotinylation"
tttttttttttttttttttttttttttttttttttcgaccaccgagatctacacatcgac

SEQ ID NO: 186 - DNA, 60 bp, Artificial Sequence
  BFor_18_TGTGAC
  modified_base 1: /mod_base="OTHER" /note="5'-biotinylation"
tttttttttttttttttttttttttttttttttttcgaccaccgagatctacactgtgac

SEQ ID NO: 187 - DNA, 60 bp, Artificial Sequence
  BFor_19_CAACAG
  modified_base 1: /mod_base="OTHER" /note="5'-biotinylation"
tttttttttttttttttttttttttttttttttttcgaccaccgagatctacaccaacag

SEQ ID NO: 188 - DNA, 60 bp, Artificial Sequence
  BFor_20_GGACAT
  modified_base 1: /mod_base="OTHER" /note="5'-biotinylation"
tttttttttttttttttttttttttttttttttttcgaccaccgagatctacacggacat

SEQ ID NO: 189 - DNA, 60 bp, Artificial Sequence
  BFor_21_ACACAC
  modified_base 1: /mod_base="OTHER" /note="5'-biotinylation"
tttttttttttttttttttttttttttttttttttcgaccaccgagatctacacacacac

SEQ ID NO: 190 - DNA, 60 bp, Artificial Sequence
  BFor_22_TAGCAC
  modified_base 1: /mod_base="OTHER" /note="5'-biotinylation"
tttttttttttttttttttttttttttttttttttcgaccaccgagatctacactagcac

SEQ ID NO: 191 - DNA, 60 bp, Artificial Sequence
  BFor_23_ATGCAG
  modified_base 1: /mod_base="OTHER" /note="5'-biotinylation"
tttttttttttttttttttttttttttttttttttcgaccaccgagatctacacatgcag

SEQ ID NO: 192 - DNA, 60 bp, Artificial Sequence
  BFor_24_CTCCAA
  modified_base 1: /mod_base="OTHER" /note="5'-biotinylation"
tttttttttttttttttttttttttttttttttttcgaccaccgagatctacacctccaa

SEQ ID NO: 193 - DNA, 60 bp, Artificial Sequence
  BFor_25_TCTCAG
  modified_base 1: /mod_base="OTHER" /note="5'-biotinylation"
tttttttttttttttttttttttttttttttttttcgaccaccgagatctacactctcag

SEQ ID NO: 194 - DNA, 60 bp, Artificial Sequence
  BFor_26_CGATAC
  modified_base 1: /mod_base="OTHER" /note="5'-biotinylation"
tttttttttttttttttttttttttttttttttttcgaccaccgagatctacaccgatac

SEQ ID NO: 195 - DNA, 60 bp, Artificial Sequence
  BFor_27_GCATAG
  modified_base 1: /mod_base="OTHER" /note="5'-biotinylation"
tttttttttttttttttttttttttttttttttttcgaccaccgagatctacacgcatag

SEQ ID NO: 196 - DNA, 60 bp, Artificial Sequence
  BFor_28_TGGTAG
  modified_base 1: /mod_base="OTHER" /note="5'-biotinylation"
tttttttttttttttttttttttttttttttttttcgaccaccgagatctacactggtag

SEQ ID NO: 197 - DNA, 60 bp, Artificial Sequence
  BFor_29_TCCTAC
  modified_base 1: /mod_base="OTHER" /note="5'-biotinylation"
tttttttttttttttttttttttttttttttttttcgaccaccgagatctacactcctac

SEQ ID NO: 198 - DNA, 60 bp, Artificial Sequence
  BFor_30_CGAAGA
  modified_base 1: /mod_base="OTHER" /note="5'-biotinylation"
tttttttttttttttttttttttttttttttttttcgaccaccgagatctacaccgaaga

SEQ ID NO: 199 - DNA, 60 bp, Artificial Sequence
  BFor_31_GCAAGT
  modified_base 1: /mod_base="OTHER" /note="5'-biotinylation"
tttttttttttttttttttttttttttttttttttcgaccaccgagatctacacgcaagt

SEQ ID NO: 200 - DNA, 60 bp, Artificial Sequence
  BFor_32_CAGAGT
  modified_base 1: /mod_base="OTHER" /note="5'-biotinylation"
tttttttttttttttttttttttttttttttttttcgaccaccgagatctacaccagagt

SEQ ID NO: 201 - DNA, 60 bp, Artificial Sequence
  BFor_33_TTGAGG
  modified_base 1: /mod_base="OTHER" /note="5'-biotinylation"
tttttttttttttttttttttttttttttttttttcgaccaccgagatctacacttgagg

SEQ ID NO: 202 - DNA, 60 bp, Artificial Sequence
  BFor_34_AGCAGT
  modified_base 1: /mod_base="OTHER" /note="5'-biotinylation"
tttttttttttttttttttttttttttttttttttcgaccaccgagatctacacagcagt

SEQ ID NO: 203 - DNA, 60 bp, Artificial Sequence
  BFor_35_TCCAGA
  modified_base 1: /mod_base="OTHER" /note="5'-biotinylation"
tttttttttttttttttttttttttttttttttttcgaccaccgagatctacactccaga

SEQ ID NO: 204 - DNA, 60 bp, Artificial Sequence
  BFor_36_CTTAGC
  modified_base 1: /mod_base="OTHER" /note="5'-biotinylation"
tttttttttttttttttttttttttttttttttttcgaccaccgagatctacaccttagc

SEQ ID NO: 205 - DNA, 60 bp, Artificial Sequence
  BFor_37_TGAGGT
  modified_base 1: /mod_base="OTHER" /note="5'-biotinylation"
tttttttttttttttttttttttttttttttttttcgaccaccgagatctacactgaggt

SEQ ID NO: 206 - DNA, 60 bp, Artificial Sequence
  BFor_38_ACAGGA
  modified_base 1: /mod_base="OTHER" /note="5'-biotinylation"
tttttttttttttttttttttttttttttttttttcgaccaccgagatctacacacagga

SEQ ID NO: 207 - DNA, 60 bp, Artificial Sequence
  BFor_39_AATGGG
  modified_base 1: /mod_base="OTHER" /note="5'-biotinylation"
tttttttttttttttttttttttttttttttttttcgaccaccgagatctacacaatggg

SEQ ID NO: 208 - DNA, 60 bp, Artificial Sequence
  BFor_40_GAACGA
  modified_base 1: /mod_base="OTHER" /note="5'-biotinylation"
tttttttttttttttttttttttttttttttttttcgaccaccgagatctacacgaacga

SEQ ID NO: 209 - DNA, 60 bp, Artificial Sequence
  BFor_41_CTACGT
  modified_base 1: /mod_base="OTHER" /note="5'-biotinylation"
tttttttttttttttttttttttttttttttttttcgaccaccgagatctacacctacgt

SEQ ID NO: 210 - DNA, 60 bp, Artificial Sequence
  BFor_42_TACCGT
  modified_base 1: /mod_base="OTHER" /note="5'-biotinylation"
tttttttttttttttttttttttttttttttttttcgaccaccgagatctacactaccgt

SEQ ID NO: 211 - DNA, 60 bp, Artificial Sequence
  BFor_43_AGTCGA
  modified_base 1: /mod_base="OTHER" /note="5'-biotinylation"
tttttttttttttttttttttttttttttttttttcgaccaccgagatctacacagtcga

SEQ ID NO: 212 - DNA, 60 bp, Artificial Sequence
  BFor_44_GTATGC
  modified_base 1: /mod_base="OTHER" /note="5'-biotinylation"
tttttttttttttttttttttttttttttttttttcgaccaccgagatctacacgtatgc

SEQ ID NO: 213 - DNA, 60 bp, Artificial Sequence
  BFor_45_AAGTGC
  modified_base 1: /mod_base="OTHER" /note="5'-biotinylation"
tttttttttttttttttttttttttttttttttttcgaccaccgagatctacacaagtgc

SEQ ID NO: 214 - DNA, 60 bp, Artificial Sequence
  BFor_46_TCGTGT
  modified_base 1: /mod_base="OTHER" /note="5'-biotinylation"
tttttttttttttttttttttttttttttttttttcgaccaccgagatctacactcgtgt

SEQ ID NO: 215 - DNA, 60 bp, Artificial Sequence
  BFor_47_CTGTGA
  modified_base 1: /mod_base="OTHER" /note="5'-biotinylation"
tttttttttttttttttttttttttttttttttttcgaccaccgagatctacacctgtga

SEQ ID NO: 216 - DNA, 60 bp, Artificial Sequence
  BFor_48_ATCTGG
  modified_base 1: /mod_base="OTHER" /note="5'-biotinylation"
tttttttttttttttttttttttttttttttttttcgaccaccgagatctacacatctgg

SEQ ID NO: 217 - DNA, 60 bp, Artificial Sequence
  BFor_49_CGTTGT
  modified_base 1: /mod_base="OTHER" /note="5'-biotinylation"
tttttttttttttttttttttttttttttttttttcgaccaccgagatctacaccgttgt

SEQ ID NO: 218 - DNA, 60 bp, Artificial Sequence
  BFor_50_GCTTGA
  modified_base 1: /mod_base="OTHER" /note="5'-biotinylation"
tttttttttttttttttttttttttttttttttttcgaccaccgagatctacacgcttga

SEQ ID NO: 219 - DNA, 60 bp, Artificial Sequence
  BFor_51_TGAACG
  modified_base 1: /mod_base="OTHER" /note="5'-biotinylation"
tttttttttttttttttttttttttttttttttttcgaccaccgagatctacactgaacg

SEQ ID NO: 220 - DNA, 60 bp, Artificial Sequence
  BFor_52_ACGACT
  modified_base 1: /mod_base="OTHER" /note="5'-biotinylation"
tttttttttttttttttttttttttttttttttttcgaccaccgagatctacacacgact

SEQ ID NO: 221 - DNA, 60 bp, Artificial Sequence
  BFor_53_GACACT
  modified_base 1: /mod_base="OTHER" /note="5'-biotinylation"
tttttttttttttttttttttttttttttttttttcgaccaccgagatctacacgacact

SEQ ID NO: 222 - DNA, 60 bp, Artificial Sequence
  BFor_54_TTCACC
  modified_base 1: /mod_base="OTHER" /note="5'-biotinylation"
tttttttttttttttttttttttttttttttttttcgaccaccgagatctacacttcacc

SEQ ID NO: 223 - DNA, 60 bp, Artificial Sequence
  BFor_55_GTTACG
  modified_base 1: /mod_base="OTHER" /note="5'-biotinylation"
tttttttttttttttttttttttttttttttttttcgaccaccgagatctacacgttacg

SEQ ID NO: 224 - DNA, 60 bp, Artificial Sequence
  BFor_56_CAAGCA
  modified_base 1: /mod_base="OTHER" /note="5'-biotinylation"
tttttttttttttttttttttttttttttttttttcgaccaccgagatctacaccaagca

SEQ ID NO: 225 - DNA, 60 bp, Artificial Sequence
  BFor_57_TAGGCT
  modified_base 1: /mod_base="OTHER" /note="5'-biotinylation"
tttttttttttttttttttttttttttttttttttcgaccaccgagatctacactaggct

SEQ ID NO: 226 - DNA, 60 bp, Artificial Sequence
  BFor_58_AGTGCT
  modified_base 1: /mod_base="OTHER" /note="5'-biotinylation"
tttttttttttttttttttttttttttttttttttcgaccaccgagatctacacagtgct

SEQ ID NO: 227 - DNA, 60 bp, Artificial Sequence
  BFor_59_TCTGCA
  modified_base 1: /mod_base="OTHER" /note="5'-biotinylation"
tttttttttttttttttttttttttttttttttttcgaccaccgagatctacactctgca

SEQ ID NO: 228 - DNA, 60 bp, Artificial Sequence
  BFor_60_TCACCT
  modified_base 1: /mod_base="OTHER" /note="5'-biotinylation"
tttttttttttttttttttttttttttttttttttcgaccaccgagatctacactcacct

SEQ ID NO: 229 - DNA, 60 bp, Artificial Sequence
  BFor_61_TTGCCA
  modified_base 1: /mod_base="OTHER" /note="5'-biotinylation"
tttttttttttttttttttttttttttttttttttcgaccaccgagatctacacttgcca

SEQ ID NO: 230 - DNA, 60 bp, Artificial Sequence
  BFor_62_CATCCT
  modified_base 1: /mod_base="OTHER" /note="5'-biotinylation"
tttttttttttttttttttttttttttttttttttcgaccaccgagatctacaccatcct

SEQ ID NO: 231 - DNA, 60 bp, Artificial Sequence
  BFor_63_ATTCCC
  modified_base 1: /mod_base="OTHER" /note="5'-biotinylation"
tttttttttttttttttttttttttttttttttttcgaccaccgagatctacacattccc

SEQ ID NO: 232 - DNA, 60 bp, Artificial Sequence
  BFor_64_GGATCA
  modified_base 1: /mod_base="OTHER" /note="5'-biotinylation"
tttttttttttttttttttttttttttttttttttcgaccaccgagatctacacggatca

SEQ ID NO: 233 - DNA, 60 bp, Artificial Sequence
  BFor_65_CTATCG
  modified_base 1: /mod_base="OTHER" /note="5'-biotinylation"
tttttttttttttttttttttttttttttttttttcgaccaccgagatctacacctatcg

SEQ ID NO: 234 - DNA, 60 bp, Artificial Sequence
  BFor_66_GTGTCT
  modified_base 1: /mod_base="OTHER" /note="5'-biotinylation"
tttttttttttttttttttttttttttttttttttcgaccaccgagatctacacgtgtct

SEQ ID NO: 235 - DNA, 60 bp, Artificial Sequence
  BFor_67_TGCTCT
  modified_base 1: /mod_base="OTHER" /note="5'-biotinylation"
tttttttttttttttttttttttttttttttttttcgaccaccgagatctacactgctct

SEQ ID NO: 236 - DNA, 60 bp, Artificial Sequence
  BFor_68_ACCTCA
  modified_base 1: /mod_base="OTHER" /note="5'-biotinylation"
tttttttttttttttttttttttttttttttttttcgaccaccgagatctacacacctca

SEQ ID NO: 237 - DNA, 60 bp, Artificial Sequence
  BFor_69_GGAATC
  modified_base 1: /mod_base="OTHER" /note="5'-biotinylation"
tttttttttttttttttttttttttttttttttttcgaccaccgagatctacacggaatc

SEQ ID NO: 238 - DNA, 60 bp, Artificial Sequence
  BFor_70_CCAATG
  modified_base 1: /mod_base="OTHER" /note="5'-biotinylation"
tttttttttttttttttttttttttttttttttttcgaccaccgagatctacacccaatg

SEQ ID NO: 239 - DNA, 60 bp, Artificial Sequence
  BFor_71_TCGATC
  modified_base 1: /mod_base="OTHER" /note="5'-biotinylation"
tttttttttttttttttttttttttttttttttttcgaccaccgagatctacactcgatc

SEQ ID NO: 240 - DNA, 60 bp, Artificial Sequence
  BFor_72_GTAGTG
  modified_base 1: /mod_base="OTHER" /note="5'-biotinylation"
tttttttttttttttttttttttttttttttttttcgaccaccgagatctacacgtagtg

SEQ ID NO: 241 - DNA, 60 bp, Artificial Sequence
  BFor_73_CTGGTT
  modified_base 1: /mod_base="OTHER" /note="5'-biotinylation"
tttttttttttttttttttttttttttttttttttcgaccaccgagatctacacctggtt

SEQ ID NO: 242 - DNA, 60 bp, Artificial Sequence
  BFor_74_GACGTA
  modified_base 1: /mod_base="OTHER" /note="5'-biotinylation"
tttttttttttttttttttttttttttttttttttcgaccaccgagatctacacgacgta

SEQ ID NO: 243 - DNA, 60 bp, Artificial Sequence
  BFor_75_CGTGTA
  modified_base 1: /mod_base="OTHER" /note="5'-biotinylation"
tttttttttttttttttttttttttttttttttttcgaccaccgagatctacaccgtgta

SEQ ID NO: 244 - DNA, 60 bp, Artificial Sequence
  BFor_76_ACTGTC
  modified_base 1: /mod_base="OTHER" /note="5'-biotinylation"
tttttttttttttttttttttttttttttttttttcgaccaccgagatctacacactgtc

SEQ ID NO: 245 - DNA, 60 bp, Artificial Sequence
  BFor_77_CAGCTA
  modified_base 1: /mod_base="OTHER" /note="5'-biotinylation"
tttttttttttttttttttttttttttttttttttcgaccaccgagatctacaccagcta

SEQ ID NO: 246 - DNA, 60 bp, Artificial Sequence
  BFor_78_AGGCTT
  modified_base 1: /mod_base="OTHER" /note="5'-biotinylation"
tttttttttttttttttttttttttttttttttttcgaccaccgagatctacacaggctt

SEQ ID NO: 247 - DNA, 60 bp, Artificial Sequence
  BFor_79_AACCTG
  modified_base 1: /mod_base="OTHER" /note="5'-biotinylation"
tttttttttttttttttttttttttttttttttttcgaccaccgagatctacacaacctg

SEQ ID NO: 248 - DNA, 60 bp, Artificial Sequence
  BFor_80_TGCCTA
  modified_base 1: /mod_base="OTHER" /note="5'-biotinylation"
tttttttttttttttttttttttttttttttttttcgaccaccgagatctacactgccta

SEQ ID NO: 249 - DNA, 60 bp, Artificial Sequence
  BFor_81_GTCCTT
  modified_base 1: /mod_base="OTHER" /note="5'-biotinylation"
tttttttttttttttttttttttttttttttttttcgaccaccgagatctacacgtcctt

SEQ ID NO: 250 - DNA, 60 bp, Artificial Sequence
  BFor_82_CTTCTG
  modified_base 1: /mod_base="OTHER" /note="5'-biotinylation"
tttttttttttttttttttttttttttttttttttcgaccaccgagatctacaccttctg

SEQ ID NO: 251 - DNA, 60 bp, Artificial Sequence
  BFor_83_ACGTTG
  modified_base 1: /mod_base="OTHER" /note="5'-biotinylation"
tttttttttttttttttttttttttttttttttttcgaccaccgagatctacacacgttg

SEQ ID NO: 252 - DNA, 60 bp, Artificial Sequence
  BFor_84_AGCTTC
  modified_base 1: /mod_base="OTHER" /note="5'-biotinylation"
tttttttttttttttttttttttttttttttttttcgaccaccgagatctacacagcttc

SEQ ID NO: 253 - DNA, 60 bp, Artificial Sequence
  BFor_85_ACTCGT
  modified_base 1: /mod_base="OTHER" /note="5'-biotinylation"
tttttttttttttttttttttttttttttttttttcgaccaccgagatctacacactcgt

SEQ ID NO: 254 - DNA, 60 bp, Artificial Sequence
  BFor_86_GATTCG
  modified_base 1: /mod_base="OTHER" /note="5'-biotinylation"
tttttttttttttttttttttttttttttttttttcgaccaccgagatctacacgattcg

SEQ ID NO: 255 - DNA, 60 bp, Artificial Sequence
  BFor_87_CATTCC
  modified_base 1: /mod_base="OTHER" /note="5'-biotinylation"
tttttttttttttttttttttttttttttttttttcgaccaccgagatctacaccattcc

SEQ ID NO: 256 - DNA, 60 bp, Artificial Sequence
  BFor_88_CACTTG
  modified_base 1: /mod_base="OTHER" /note="5'-biotinylation"
tttttttttttttttttttttttttttttttttttcgaccaccgagatctacaccacttg

SEQ ID NO: 257 - DNA, 60 bp, Artificial Sequence
  BFor_89_CTCTTC
  modified_base 1: /mod_base="OTHER" /note="5'-biotinylation"
tttttttttttttttttttttttttttttttttttcgaccaccgagatctacacctcttc

SEQ ID NO: 258 - DNA, 60 bp, Artificial Sequence
  BFor_90_CTGTAC
  modified_base 1: /mod_base="OTHER" /note="5'-biotinylation"
tttttttttttttttttttttttttttttttttttcgaccaccgagatctacacctgtac

SEQ ID NO: 259 - DNA, 60 bp, Artificial Sequence
  BFor_91_GTCAGA
  modified_base 1: /mod_base="OTHER" /note="5'-biotinylation"
tttttttttttttttttttttttttttttttttttcgaccaccgagatctacacgtcaga

SEQ ID NO: 260 - DNA, 60 bp, Artificial Sequence
  BFor_92_ACTAGG
  modified_base 1: /mod_base="OTHER" /note="5'-biotinylation"
tttttttttttttttttttttttttttttttttttcgaccaccgagatctacacactagg

SEQ ID NO: 261 - DNA, 60 bp, Artificial Sequence
  BFor_93_TTAGGC
  modified_base 1: /mod_base="OTHER" /note="5'-biotinylation"
tttttttttttttttttttttttttttttttttttcgaccaccgagatctacacttaggc

SEQ ID NO: 262 - DNA, 60 bp, Artificial Sequence
  BFor_94_TATGGC
  modified_base 1: /mod_base="OTHER" /note="5'-biotinylation"
tttttttttttttttttttttttttttttttttttcgaccaccgagatctacactatggc

SEQ ID NO: 263 - DNA, 60 bp, Artificial Sequence
  BFor_95_TTACGG
  modified_base 1: /mod_base="OTHER" /note="5'-biotinylation"
tttttttttttttttttttttttttttttttttttcgaccaccgagatctacacttacgg

SEQ ID NO: 264 - DNA, 60 bp, Artificial Sequence
  BFor_96_CATTGG
  modified_base 1: /mod_base="OTHER" /note="5'-biotinylation"
tttttttttttttttttttttttttttttttttttcgaccaccgagatctacaccattgg

SEQ ID NO: 265 - DNA, 40 bp, Artificial Sequence
  CRev_1_CGTTTC
ctgtctcttatacacatctccgagcccacgagacgaaacg

SEQ ID NO: 266 - DNA, 40 bp, Artificial Sequence
  CRev_2_TGGTGT
ctgtctcttatacacatctccgagcccacgagacacacca

SEQ ID NO: 267 - DNA, 40 bp, Artificial Sequence
  CRev_3_TCTCGA
ctgtctcttatacacatctccgagcccacgagactcgaga

SEQ ID NO: 268 - DNA, 40 bp, Artificial Sequence
  CRev_4_GAAGGA
ctgtctcttatacacatctccgagcccacgagactccttc

SEQ ID NO: 269 - DNA, 40 bp, Artificial Sequence
  CRev_5_GAACAG
ctgtctcttatacacatctccgagcccacgagacctgttc

SEQ ID NO: 270 - DNA, 40 bp, Artificial Sequence
  CRev_6_GAAACC
ctgtctcttatacacatctccgagcccacgagacggtttc

SEQ ID NO: 271 - DNA, 40 bp, Artificial Sequence
  CRev_7_CAACCA
ctgtctcttatacacatctccgagcccacgagactggttg

SEQ ID NO: 272 - DNA, 40 bp, Artificial Sequence
  CRev_8_CAAAGG
ctgtctcttatacacatctccgagcccacgagaccctttg

SEQ ID NO: 273 - DNA, 40 bp, Artificial Sequence
  CRev_9_CAAGAC
ctgtctcttatacacatctccgagcccacgagacgtcttg

SEQ ID NO: 274 - DNA, 40 bp, Artificial Sequence
  CRev_10_TAAGCG
ctgtctcttatacacatctccgagcccacgagaccgctta

SEQ ID NO: 275 - DNA, 40 bp, Artificial Sequence
  CRev_11_TAACGC
ctgtctcttatacacatctccgagcccacgagacgcgtta

SEQ ID NO: 276 - DNA, 40 bp, Artificial Sequence
  CRev_12_AGACGA
ctgtctcttatacacatctccgagcccacgagactcgtct

SEQ ID NO: 277 - DNA, 40 bp, Artificial Sequence
  CRev_13_AGAGAG
ctgtctcttatacacatctccgagcccacgagacctctct

SEQ ID NO: 278 - DNA, 40 bp, Artificial Sequence
  CRev_14_AGATCC
ctgtctcttatacacatctccgagcccacgagacggatct

SEQ ID NO: 279 - DNA, 40 bp, Artificial Sequence
  CRev_15_GGAAGT
ctgtctcttatacacatctccgagcccacgagacacttcc

SEQ ID NO: 280 - DNA, 40 bp, Artificial Sequence
  CRev_16_CGAGTA
ctgtctcttatacacatctccgagcccacgagactactcg

SEQ ID NO: 281 - DNA, 40 bp, Artificial Sequence
  CRev_17_CGACAT
ctgtctcttatacacatctccgagcccacgagacatgtcg

SEQ ID NO: 282 - DNA, 40 bp, Artificial Sequence
  CRev_18_TGACTG
ctgtctcttatacacatctccgagcccacgagaccagtca

SEQ ID NO: 283 - DNA, 40 bp, Artificial Sequence
  CRev_19_ACAGCA
ctgtctcttatacacatctccgagcccacgagactgctgt

SEQ ID NO: 284 - DNA, 40 bp, Artificial Sequence
  CRev_20_ACATGG
ctgtctcttatacacatctccgagcccacgagacccatgt

SEQ ID NO: 285 - DNA, 40 bp, Artificial Sequence
  CRev_21_ACACAC
ctgtctcttatacacatctccgagcccacgagacgtgtgt

SEQ ID NO: 286 - DNA, 40 bp, Artificial Sequence
  CRev_22_GCACTA
ctgtctcttatacacatctccgagcccacgagactagtgc

SEQ ID NO: 287 - DNA, 40 bp, Artificial Sequence
  CRev_23_GCAGAT
ctgtctcttatacacatctccgagcccacgagacatctgc

SEQ ID NO: 288 - DNA, 40 bp, Artificial Sequence
  CRev_24_CCAACT
ctgtctcttatacacatctccgagcccacgagacagttgg

SEQ ID NO: 289 - DNA, 40 bp, Artificial Sequence
  CRev_25_TCAGTC
ctgtctcttatacacatctccgagcccacgagacgactga

SEQ ID NO: 290 - DNA, 40 bp, Artificial Sequence
  CRev_26_ATACCG
ctgtctcttatacacatctccgagcccacgagaccggtat

SEQ ID NO: 291 - DNA, 40 bp, Artificial Sequence
  CRev_27_ATAGGC
ctgtctcttatacacatctccgagcccacgagacgcctat

SEQ ID NO: 292 - DNA, 40 bp, Artificial Sequence
  CRev_28_GTAGTG
ctgtctcttatacacatctccgagcccacgagaccactac

SEQ ID NO: 293 - DNA, 40 bp, Artificial Sequence
  CRev_29_CTACTC
ctgtctcttatacacatctccgagcccacgagacgagtag

SEQ ID NO: 294 - DNA, 40 bp, Artificial Sequence
  CRev_30_AAGACG
ctgtctcttatacacatctccgagcccacgagaccgtctt

SEQ ID NO: 295 - DNA, 40 bp, Artificial Sequence
  CRev_31_AAGTGC
ctgtctcttatacacatctccgagcccacgagacgcactt

SEQ ID NO: 296 - DNA, 40 bp, Artificial Sequence
  CRev_32_GAGTCA
ctgtctcttatacacatctccgagcccacgagactgactc

SEQ ID NO: 297 - DNA, 40 bp, Artificial Sequence
  CRev_33_GAGGTT
ctgtctcttatacacatctccgagcccacgagacaacctc

SEQ ID NO: 298 - DNA, 40 bp, Artificial Sequence
  CRev_34_CAGTAG
ctgtctcttatacacatctccgagcccacgagacctactg

SEQ ID NO: 299 - DNA, 40 bp, Artificial Sequence
  CRev_35_CAGATC
ctgtctcttatacacatctccgagcccacgagacgatctg

SEQ ID NO: 300 - DNA, 40 bp, Artificial Sequence
  CRev_36_TAGCCT
ctgtctcttatacacatctccgagcccacgagacaggcta

SEQ ID NO: 301 - DNA, 40 bp, Artificial Sequence
  CRev_37_AGGTTG
ctgtctcttatacacatctccgagcccacgagaccaacct

SEQ ID NO: 302 - DNA, 40 bp, Artificial Sequence
  CRev_38_AGGAAC
ctgtctcttatacacatctccgagcccacgagacgttcct

SEQ ID NO: 303 - DNA, 40 bp, Artificial Sequence
  CRev_39_TGGGAA
ctgtctcttatacacatctccgagcccacgagacttccca

SEQ ID NO: 304 - DNA, 40 bp, Artificial Sequence
  CRev_40_ACGAGA
ctgtctcttatacacatctccgagcccacgagactctcgt

SEQ ID NO: 305 - DNA, 40 bp, Artificial Sequence
  CRev_41_ACGTCT
ctgtctcttatacacatctccgagcccacgagacagacgt

SEQ ID NO: 306 - DNA, 40 bp, Artificial Sequence
  CRev_42_CCGTTA
ctgtctcttatacacatctccgagcccacgagactaacgg

SEQ ID NO: 307 - DNA, 40 bp, Artificial Sequence
  CRev_43_TCGAAG
ctgtctcttatacacatctccgagcccacgagaccttcga

SEQ ID NO: 308 - DNA, 40 bp, Artificial Sequence
  CRev_44_ATGCGT
ctgtctcttatacacatctccgagcccacgagacacgcat

SEQ ID NO: 309 - DNA, 40 bp, Artificial Sequence
  CRev_45_GTGCAA
ctgtctcttatacacatctccgagcccacgagacttgcac

SEQ ID NO: 310 - DNA, 40 bp, Artificial Sequence
  CRev_46_GTGTTC
ctgtctcttatacacatctccgagcccacgagacgaacac

SEQ ID NO: 311 - DNA, 40 bp, Artificial Sequence
  CRev_47_GTGACT
ctgtctcttatacacatctccgagcccacgagacagtcac

SEQ ID NO: 312 - DNA, 40 bp, Artificial Sequence
  CRev_48_CTGGAT
ctgtctcttatacacatctccgagcccacgagacatccag

SEQ ID NO: 313 - DNA, 40 bp, Artificial Sequence
  CRev_49_TTGTCG
ctgtctcttatacacatctccgagcccacgagaccgacaa

SEQ ID NO: 314 - DNA, 40 bp, Artificial Sequence
  CRev_50_TTGAGC
ctgtctcttatacacatctccgagcccacgagacgctcaa

SEQ ID NO: 315 - DNA, 40 bp, Artificial Sequence
  CRev_51_AACGTG
ctgtctcttatacacatctccgagcccacgagaccacgtt

SEQ ID NO: 316 - DNA, 40 bp, Artificial Sequence
  CRev_52_GACTAC
ctgtctcttatacacatctccgagcccacgagacgtagtc

SEQ ID NO: 317 - DNA, 40 bp, Artificial Sequence
  CRev_53_CACTGA
ctgtctcttatacacatctccgagcccacgagactcagtg

SEQ ID NO: 318 - DNA, 40 bp, Artificial Sequence
  CRev_54_CACCTT
ctgtctcttatacacatctccgagcccacgagacaaggtg

SEQ ID NO: 319 - DNA, 40 bp, Artificial Sequence
  CRev_55_TACGGT
ctgtctcttatacacatctccgagcccacgagacaccgta

SEQ ID NO: 320 - DNA, 40 bp, Artificial Sequence
  CRev_56_AGCACA
ctgtctcttatacacatctccgagcccacgagactgtgct

SEQ ID NO: 321 - DNA, 40 bp, Artificial Sequence
  CRev_57_GGCTTA
ctgtctcttatacacatctccgagcccacgagactaagcc

SEQ ID NO: 322 - DNA, 40 bp, Artificial Sequence
  CRev_58_TGCTAG
ctgtctcttatacacatctccgagcccacgagacctagca

SEQ ID NO: 323 - DNA, 40 bp, Artificial Sequence
  CRev_59_TGCATC
ctgtctcttatacacatctccgagcccacgagacgatgca

SEQ ID NO: 324 - DNA, 40 bp, Artificial Sequence
  CRev_60_ACCTTC
ctgtctcttatacacatctccgagcccacgagacgaaggt

SEQ ID NO: 325 - DNA, 40 bp, Artificial Sequence
  CRev_61_GCCATT
ctgtctcttatacacatctccgagcccacgagacaatggc

SEQ ID NO: 326 - DNA, 40 bp, Artificial Sequence
  CRev_62_TCCTCA
ctgtctcttatacacatctccgagcccacgagactgagga

SEQ ID NO: 327 - DNA, 40 bp, Artificial Sequence
  CRev_63_TCCCAT
ctgtctcttatacacatctccgagcccacgagacatggga

SEQ ID NO: 328 - DNA, 40 bp, Artificial Sequence
  CRev_64_ATCAGG
ctgtctcttatacacatctccgagcccacgagaccctgat

SEQ ID NO: 329 - DNA, 40 bp, Artificial Sequence
  CRev_65_ATCGCT
ctgtctcttatacacatctccgagcccacgagacagcgat

SEQ ID NO: 330 - DNA, 40 bp, Artificial Sequence
  CRev_66_GTCTGT
ctgtctcttatacacatctccgagcccacgagacacagac

SEQ ID NO: 331 - DNA, 40 bp, Artificial Sequence
  CRev_67_CTCTTG
ctgtctcttatacacatctccgagcccacgagaccaagag

SEQ ID NO: 332 - DNA, 40 bp, Artificial Sequence
  CRev_68_CTCAAC
ctgtctcttatacacatctccgagcccacgagacgttgag

SEQ ID NO: 333 - DNA, 40 bp, Artificial Sequence
  CRev_69_AATCGG
ctgtctcttatacacatctccgagcccacgagacccgatt

SEQ ID NO: 334 - DNA, 40 bp, Artificial Sequence
  CRev_70_AATGCC
ctgtctcttatacacatctccgagcccacgagacggcatt

SEQ ID NO: 335 - DNA, 40 bp, Artificial Sequence
  CRev_71_GATCTC
ctgtctcttatacacatctccgagcccacgagacgagatc

SEQ ID NO: 336 - DNA, 40 bp, Artificial Sequence
  CRev_72_AGTGGT
ctgtctcttatacacatctccgagcccacgagacaccact

SEQ ID NO: 337 - DNA, 40 bp, Artificial Sequence
  CRev_73_GGTTCT
ctgtctcttatacacatctccgagcccacgagacagaacc

SEQ ID NO: 338 - DNA, 40 bp, Artificial Sequence
  CRev_74_CGTAGA
ctgtctcttatacacatctccgagcccacgagactctacg

SEQ ID NO: 339 - DNA, 40 bp, Artificial Sequence
  CRev_75_TGTACG
ctgtctcttatacacatctccgagcccacgagaccgtaca

SEQ ID NO: 340 - DNA, 40 bp, Artificial Sequence
  CRev_76_TGTCAC
ctgtctcttatacacatctccgagcccacgagacgtgaca

SEQ ID NO: 341 - DNA, 40 bp, Artificial Sequence
  CRev_77_GCTACA
ctgtctcttatacacatctccgagcccacgagactgtagc

SEQ ID NO: 342 - DNA, 40 bp, Artificial Sequence
  CRev_78_GCTTAG
ctgtctcttatacacatctccgagcccacgagacctaagc

SEQ ID NO: 343 - DNA, 40 bp, Artificial Sequence
  CRev_79_CCTGAA
ctgtctcttatacacatctccgagcccacgagacttcagg

SEQ ID NO: 344 - DNA, 40 bp, Artificial Sequence
  CRev_80_CCTATG
ctgtctcttatacacatctccgagcccacgagaccatagg

SEQ ID NO: 345 - DNA, 40 bp, Artificial Sequence
  CRev_81_CCTTGT
ctgtctcttatacacatctccgagcccacgagacacaagg

SEQ ID NO: 346 - DNA, 40 bp, Artificial Sequence
  CRev_82_TCTGCT
ctgtctcttatacacatctccgagcccacgagacagcaga

SEQ ID NO: 347 - DNA, 40 bp, Artificial Sequence
  CRev_83_GTTGAC
ctgtctcttatacacatctccgagcccacgagacgtcaac

SEQ ID NO: 348 - DNA, 40 bp, Artificial Sequence
  CRev_84_CTTCAG
ctgtctcttatacacatctccgagcccacgagacctgaag

SEQ ID NO: 349 - DNA, 40 bp, Artificial Sequence
  CRev_85_TCGTAC
ctgtctcttatacacatctccgagcccacgagacgtacga

SEQ ID NO: 350 - DNA, 40 bp, Artificial Sequence
  CRev_86_TTCGGA
ctgtctcttatacacatctccgagcccacgagactccgaa

SEQ ID NO: 351 - DNA, 40 bp, Artificial Sequence
  CRev_87_TTCCCA
ctgtctcttatacacatctccgagcccacgagactgggaa

SEQ ID NO: 352 - DNA, 40 bp, Artificial Sequence
  CRev_88_CTTGCA
ctgtctcttatacacatctccgagcccacgagactgcaag

SEQ ID NO: 353 - DNA, 40 bp, Artificial Sequence
  CRev_89_CTTCCT
ctgtctcttatacacatctccgagcccacgagacaggaag

SEQ ID NO: 354 - DNA, 40 bp, Artificial Sequence
  CRev_90_GTACCT
ctgtctcttatacacatctccgagcccacgagacaggtac

SEQ ID NO: 355 - DNA, 40 bp, Artificial Sequence
  CRev_91_CAGAGT
ctgtctcttatacacatctccgagcccacgagacactctg

SEQ ID NO: 356 - DNA, 40 bp, Artificial Sequence
  CRev_92_TAGGAC
ctgtctcttatacacatctccgagcccacgagacgtccta

SEQ ID NO: 357 - DNA, 40 bp, Artificial Sequence
  CRev_93_AGGCTT
ctgtctcttatacacatctccgagcccacgagacaagcct

SEQ ID NO: 358 - DNA, 40 bp, Artificial Sequence
  CRev_94_TGGCTA
ctgtctcttatacacatctccgagcccacgagactagcca

SEQ ID NO: 359 - DNA, 40 bp, Artificial Sequence
  CRev_95_ACGGTT
ctgtctcttatacacatctccgagcccacgagacaaccgt

SEQ ID NO: 360 - DNA, 40 bp, Artificial Sequence
  CRev_96_TTGGCA
ctgtctcttatacacatctccgagcccacgagactgccaa

SEQ ID NO: 361 - DNA, 39 bp, Artificial Sequence
  DRev_1_GTTTCC
ctgtctcttatacacatctgacgctgccgacgaggaaac

SEQ ID NO: 362 - DNA, 39 bp, Artificial Sequence
  DRev_2_GGTGTT
ctgtctcttatacacatctgacgctgccgacgaaacacc

SEQ ID NO: 363 - DNA, 39 bp, Artificial Sequence
  DRev_3_CTCGAT
ctgtctcttatacacatctgacgctgccgacgaatcgag

SEQ ID NO: 364 - DNA, 39 bp, Artificial Sequence
  DRev_4_AAGGAG
ctgtctcttatacacatctgacgctgccgacgactcctt

SEQ ID NO: 365 - DNA, 39 bp, Artificial Sequence
  DRev_5_AACAGG
ctgtctcttatacacatctgacgctgccgacgacctgtt

SEQ ID NO: 366 - DNA, 39 bp, Artificial Sequence
  DRev_6_AAACCG
ctgtctcttatacacatctgacgctgccgacgacggttt

SEQ ID NO: 367 - DNA, 39 bp, Artificial Sequence
  DRev_7_AACCAC
ctgtctcttatacacatctgacgctgccgacgagtggtt

SEQ ID NO: 368 - DNA, 39 bp, Artificial Sequence
  DRev_8_AAAGGC
ctgtctcttatacacatctgacgctgccgacgagccttt

SEQ ID NO: 369 - DNA, 39 bp, Artificial Sequence
  DRev_9_AAGACC
ctgtctcttatacacatctgacgctgccgacgaggtctt

SEQ ID NO: 370 - DNA, 39 bp, Artificial Sequence
  DRev_10_AAGCGT
ctgtctcttatacacatctgacgctgccgacgaacgctt

SEQ ID NO: 371 - DNA, 39 bp, Artificial Sequence
  DRev_11_AACGCT
ctgtctcttatacacatctgacgctgccgacgaagcgtt

SEQ ID NO: 372 - DNA, 39 bp, Artificial Sequence
  DRev_12_GACGAA
ctgtctcttatacacatctgacgctgccgacgattcgtc

SEQ ID NO: 373 - DNA, 39 bp, Artificial Sequence
  DRev_13_GAGAGA
ctgtctcttatacacatctgacgctgccgacgatctctc

SEQ ID NO: 374 - DNA, 39 bp, Artificial Sequence
  DRev_14_GATCCA
ctgtctcttatacacatctgacgctgccgacgatggatc

SEQ ID NO: 375 - DNA, 39 bp, Artificial Sequence
  DRev_15_GAAGTG
ctgtctcttatacacatctgacgctgccgacgacacttc

SEQ ID NO: 376 - DNA, 39 bp, Artificial Sequence
  DRev_16_GAGTAC
ctgtctcttatacacatctgacgctgccgacgagtactc

SEQ ID NO: 377 - DNA, 39 bp, Artificial Sequence
  DRev_17_GACATC
ctgtctcttatacacatctgacgctgccgacgagatgtc

SEQ ID NO: 378 - DNA, 39 bp, Artificial Sequence
  DRev_18_GACTGT
ctgtctcttatacacatctgacgctgccgacgaacagtc

SEQ ID NO: 379 - DNA, 39 bp, Artificial Sequence
  DRev_19_CAGCAA
ctgtctcttatacacatctgacgctgccgacgattgctg

SEQ ID NO: 380 - DNA, 39 bp, Artificial Sequence
  DRev_20_CATGGA
ctgtctcttatacacatctgacgctgccgacgatccatg

SEQ ID NO: 381 - DNA, 39 bp, Artificial Sequence
  DRev_21_CACACA
ctgtctcttatacacatctgacgctgccgacgatgtgtg

SEQ ID NO: 382 - DNA, 39 bp, Artificial Sequence
  DRev_22_CACTAG
ctgtctcttatacacatctgacgctgccgacgactagtg

SEQ ID NO: 383 - DNA, 39 bp, Artificial Sequence
  DRev_23_CAGATG
ctgtctcttatacacatctgacgctgccgacgacatctg

SEQ ID NO: 384 - DNA, 39 bp, Artificial Sequence
  DRev_24_CAACTC
ctgtctcttatacacatctgacgctgccgacgagagttg

SEQ ID NO: 385 - DNA, 39 bp, Artificial Sequence
  DRev_25_CAGTCT
ctgtctcttatacacatctgacgctgccgacgaagactg

SEQ ID NO: 386 - DNA, 39 bp, Artificial Sequence
  DRev_26_TACCGA
ctgtctcttatacacatctgacgctgccgacgatcggta

SEQ ID NO: 387 - DNA, 39 bp, Artificial Sequence
  DRev_27_TAGGCA
ctgtctcttatacacatctgacgctgccgacgatgccta

SEQ ID NO: 388 - DNA, 39 bp, Artificial Sequence
  DRev_28_TAGTGG
ctgtctcttatacacatctgacgctgccgacgaccacta

SEQ ID NO: 389 - DNA, 39 bp, Artificial Sequence
  DRev_29_TACTCC
ctgtctcttatacacatctgacgctgccgacgaggagta

SEQ ID NO: 390 - DNA, 39 bp, Artificial Sequence
  DRev_30_AGACGA
ctgtctcttatacacatctgacgctgccgacgatcgtct

SEQ ID NO: 391 - DNA, 39 bp, Artificial Sequence
  DRev_31_AGTGCA
ctgtctcttatacacatctgacgctgccgacgatgcact

SEQ ID NO: 392 - DNA, 39 bp, Artificial Sequence
  DRev_32_AGTCAG
ctgtctcttatacacatctgacgctgccgacgactgact

SEQ ID NO: 393 - DNA, 39 bp, Artificial Sequence
  DRev_33_AGGTTG
ctgtctcttatacacatctgacgctgccgacgacaacct

SEQ ID NO: 394 - DNA, 39 bp, Artificial Sequence
  DRev_34_AGTAGC
ctgtctcttatacacatctgacgctgccgacgagctact

SEQ ID NO: 395 - DNA, 39 bp, Artificial Sequence
  DRev_35_AGATCC
ctgtctcttatacacatctgacgctgccgacgaggatct

SEQ ID NO: 396 - DNA, 39 bp, Artificial Sequence
  DRev_36_AGCCTT
ctgtctcttatacacatctgacgctgccgacgaaaggct

SEQ ID NO: 397 - DNA, 39 bp, Artificial Sequence
  DRev_37_GGTTGA
ctgtctcttatacacatctgacgctgccgacgatcaacc

SEQ ID NO: 398 - DNA, 39 bp, Artificial Sequence
  DRev_38_GGAACA
ctgtctcttatacacatctgacgctgccgacgatgttcc

SEQ ID NO: 399 - DNA, 39 bp, Artificial Sequence
  DRev_39_GGGAAT
ctgtctcttatacacatctgacgctgccgacgaattccc

SEQ ID NO: 400 - DNA, 39 bp, Artificial Sequence
  DRev_40_CGAGAA
ctgtctcttatacacatctgacgctgccgacgattctcg

SEQ ID NO: 401 - DNA, 39 bp, Artificial Sequence
  DRev_41_CGTCTA
ctgtctcttatacacatctgacgctgccgacgatagacg

SEQ ID NO: 402 - DNA, 39 bp, Artificial Sequence
  DRev_42_CGTTAC
ctgtctcttatacacatctgacgctgccgacgagtaacg

SEQ ID NO: 403 - DNA, 39 bp, Artificial Sequence
  DRev_43_CGAAGT
ctgtctcttatacacatctgacgctgccgacgaacttcg

SEQ ID NO: 404 - DNA, 39 bp, Artificial Sequence
  DRev_44_TGCGTA
ctgtctcttatacacatctgacgctgccgacgatacgca

SEQ ID NO: 405 - DNA, 39 bp, Artificial Sequence
  DRev_45_TGCAAG
ctgtctcttatacacatctgacgctgccgacgacttgca

SEQ ID NO: 406 - DNA, 39 bp, Artificial Sequence
  DRev_46_TGTTCG
ctgtctcttatacacatctgacgctgccgacgacgaaca

SEQ ID NO: 407 - DNA, 39 bp, Artificial Sequence
  DRev_47_TGACTG
ctgtctcttatacacatctgacgctgccgacgacagtca

SEQ ID NO: 408 - DNA, 39 bp, Artificial Sequence
  DRev_48_TGGATC
ctgtctcttatacacatctgacgctgccgacgagatcca

SEQ ID NO: 409 - DNA, 39 bp, Artificial Sequence
  DRev_49_TGTCGT
ctgtctcttatacacatctgacgctgccgacgaacgaca

SEQ ID NO: 410 - DNA, 39 bp, Artificial Sequence
  DRev_50_TGAGCT
ctgtctcttatacacatctgacgctgccgacgaagctca

SEQ ID NO: 411 - DNA, 39 bp, Artificial Sequence
  DRev_51_ACGTGA
ctgtctcttatacacatctgacgctgccgacgatcacgt

SEQ ID NO: 412 - DNA, 39 bp, Artificial Sequence
  DRev_52_ACTACG
ctgtctcttatacacatctgacgctgccgacgacgtagt

SEQ ID NO: 413 - DNA, 39 bp, Artificial Sequence
  DRev_53_ACTGAC
ctgtctcttatacacatctgacgctgccgacgagtcagt

SEQ ID NO: 414 - DNA, 39 bp, Artificial Sequence
  DRev_54_ACCTTC
ctgtctcttatacacatctgacgctgccgacgagaaggt

SEQ ID NO: 415 - DNA, 39 bp, Artificial Sequence
  DRev_55_ACGGTT
ctgtctcttatacacatctgacgctgccgacgaaaccgt

SEQ ID NO: 416 - DNA, 39 bp, Artificial Sequence
  DRev_56_GCACAA
ctgtctcttatacacatctgacgctgccgacgattgtgc

SEQ ID NO: 417 - DNA, 39 bp, Artificial Sequence
  DRev_57_GCTTAG
ctgtctcttatacacatctgacgctgccgacgactaagc

SEQ ID NO: 418 - DNA, 39 bp, Artificial Sequence
  DRev_58_GCTAGT
ctgtctcttatacacatctgacgctgccgacgaactagc

SEQ ID NO: 419 - DNA, 39 bp, Artificial Sequence
  DRev_59_GCATCT
ctgtctcttatacacatctgacgctgccgacgaagatgc

SEQ ID NO: 420 - DNA, 39 bp, Artificial Sequence
  DRev_60_CCTTCA
ctgtctcttatacacatctgacgctgccgacgatgaagg

SEQ ID NO: 421 - DNA, 39 bp, Artificial Sequence
  DRev_61_CCATTG
ctgtctcttatacacatctgacgctgccgacgacaatgg

SEQ ID NO: 422 - DNA, 39 bp, Artificial Sequence
  DRev_62_CCTCAT
ctgtctcttatacacatctgacgctgccgacgaatgagg

SEQ ID NO: 423 - DNA, 39 bp, Artificial Sequence
  DRev_63_CCCATT
ctgtctcttatacacatctgacgctgccgacgaaatggg

SEQ ID NO: 424 - DNA, 39 bp, Artificial Sequence
  DRev_64_TCAGGA
ctgtctcttatacacatctgacgctgccgacgatcctga

SEQ ID NO: 425 - DNA, 39 bp, Artificial Sequence
  DRev_65_TCGCTA
ctgtctcttatacacatctgacgctgccgacgatagcga

SEQ ID NO: 426 - DNA, 39 bp, Artificial Sequence
  DRev_66_TCTGTG
ctgtctcttatacacatctgacgctgccgacgacacaga

SEQ ID NO: 427 - DNA, 39 bp, Artificial Sequence
  DRev_67_TCTTGC
ctgtctcttatacacatctgacgctgccgacgagcaaga

SEQ ID NO: 428 - DNA, 39 bp, Artificial Sequence
  DRev_68_TCAACC
ctgtctcttatacacatctgacgctgccgacgaggttga

SEQ ID NO: 429 - DNA, 39 bp, Artificial Sequence
  DRev_69_ATCGGA
ctgtctcttatacacatctgacgctgccgacgatccgat

SEQ ID NO: 430 - DNA, 39 bp, Artificial Sequence
  DRev_70_ATGCCA
ctgtctcttatacacatctgacgctgccgacgatggcat

SEQ ID NO: 431 - DNA, 39 bp, Artificial Sequence
  DRev_71_ATCTCG
ctgtctcttatacacatctgacgctgccgacgacgagat

SEQ ID NO: 432 - DNA, 39 bp, Artificial Sequence
  DRev_72_GTGGTA
ctgtctcttatacacatctgacgctgccgacgataccac

SEQ ID NO: 433 - DNA, 39 bp, Artificial Sequence
  DRev_73_GTTCTG
ctgtctcttatacacatctgacgctgccgacgacagaac

SEQ ID NO: 434 - DNA, 39 bp, Artificial Sequence
  DRev_74_GTAGAC
ctgtctcttatacacatctgacgctgccgacgagtctac

SEQ ID NO: 435 - DNA, 39 bp, Artificial Sequence
  DRev_75_GTACGT
ctgtctcttatacacatctgacgctgccgacgaacgtac

SEQ ID NO: 436 - DNA, 39 bp, Artificial Sequence
  DRev_76_GTCACT
ctgtctcttatacacatctgacgctgccgacgaagtgac

SEQ ID NO: 437 - DNA, 39 bp, Artificial Sequence
  DRev_77_CTACAG
ctgtctcttatacacatctgacgctgccgacgactgtag

SEQ ID NO: 438 - DNA, 39 bp, Artificial Sequence
  DRev_78_CTTAGG
ctgtctcttatacacatctgacgctgccgacgacctaag

SEQ ID NO: 439 - DNA, 39 bp, Artificial Sequence
  DRev_79_CTGAAC
ctgtctcttatacacatctgacgctgccgacgagttcag

SEQ ID NO: 440 - DNA, 39 bp, Artificial Sequence
  DRev_80_CTATGC
ctgtctcttatacacatctgacgctgccgacgagcatag

SEQ ID NO: 441 - DNA, 39 bp, Artificial Sequence
  DRev_81_CTTGTC
ctgtctcttatacacatctgacgctgccgacgagacaag

SEQ ID NO: 442 - DNA, 39 bp, Artificial Sequence
  DRev_82_CTGCTT
ctgtctcttatacacatctgacgctgccgacgaaagcag

SEQ ID NO: 443 - DNA, 39 bp, Artificial Sequence
  DRev_83_TTGACG
ctgtctcttatacacatctgacgctgccgacgacgtcaa

SEQ ID NO: 444 - DNA, 39 bp, Artificial Sequence
  DRev_84_TTCAGC
ctgtctcttatacacatctgacgctgccgacgagctgaa

SEQ ID NO: 445 - DNA, 39 bp, Artificial Sequence
  DRev_85_CGTACT
ctgtctcttatacacatctgacgctgccgacgaagtacg

SEQ ID NO: 446 - DNA, 39 bp, Artificial Sequence
  DRev_86_TCGGAT
ctgtctcttatacacatctgacgctgccgacgaatccga

SEQ ID NO: 447 - DNA, 39 bp, Artificial Sequence
  DRev_87_TCCCAT
ctgtctcttatacacatctgacgctgccgacgaatggga

SEQ ID NO: 448 - DNA, 39 bp, Artificial Sequence
  DRev_88_TTGCAC
ctgtctcttatacacatctgacgctgccgacgagtgcaa

SEQ ID NO: 449 - DNA, 39 bp, Artificial Sequence
  DRev_89_TTCCTC
ctgtctcttatacacatctgacgctgccgacgagaggaa

SEQ ID NO: 450 - DNA, 39 bp, Artificial Sequence
  DRev_90_TACCTG
ctgtctcttatacacatctgacgctgccgacgacaggta

SEQ ID NO: 451 - DNA, 39 bp, Artificial Sequence
  DRev_91_AGAGTC
ctgtctcttatacacatctgacgctgccgacgagactct

SEQ ID NO: 452 - DNA, 39 bp, Artificial Sequence
  DRev_92_AGGACT
ctgtctcttatacacatctgacgctgccgacgaagtcct

SEQ ID NO: 453 - DNA, 39 bp, Artificial Sequence
  DRev_93_GGCTTA
ctgtctcttatacacatctgacgctgccgacgataagcc

SEQ ID NO: 454 - DNA, 39 bp, Artificial Sequence
  DRev_94_GGCTAT
ctgtctcttatacacatctgacgctgccgacgaatagcc

SEQ ID NO: 455 - DNA, 39 bp, Artificial Sequence
  DRev_95_CGGTTA
ctgtctcttatacacatctgacgctgccgacgataaccg

SEQ ID NO: 456 - DNA, 39 bp, Artificial Sequence
  DRev_96_TGGCAT
ctgtctcttatacacatctgacgctgccgacgaatgcca

SEQ ID NO: 457 - DNA, 27 bp, Artificial Sequence
  ARev_1_TTCCGT_A-ov
aacggaaatctcgtatgccgtcttctg

SEQ ID NO: 458 - DNA, 27 bp, Artificial Sequence
  ARev_2_TGTTGG_A-ov
accaacaatctcgtatgccgtcttctg

SEQ ID NO: 459 - DNA, 27 bp, Artificial Sequence
  ARev_3_CGATCT_A-ov
aagatcgatctcgtatgccgtcttctg

SEQ ID NO: 460 - DNA, 27 bp, Artificial Sequence
  ARev_4_GGAGAA_A-ov
attctccatctcgtatgccgtcttctg

SEQ ID NO: 461 - DNA, 27 bp, Artificial Sequence
  ARev_5_CAGGAA_A-ov
attcctgatctcgtatgccgtcttctg

SEQ ID NO: 462 - DNA, 27 bp, Artificial Sequence
  ARev_6_ACCGAA_A-ov
attcggtatctcgtatgccgtcttctg

SEQ ID NO: 463 - DNA, 27 bp, Artificial Sequence
  ARev_7_CCACAA_A-ov
attgtggatctcgtatgccgtcttctg

SEQ ID NO: 464 - DNA, 27 bp, Artificial Sequence
  ARev_8_AGGCAA_A-ov
attgcctatctcgtatgccgtcttctg

SEQ ID NO: 465 - DNA, 27 bp, Artificial Sequence
  ARev_9_GACCAA_A-ov
attggtcatctcgtatgccgtcttctg

SEQ ID NO: 466 - DNA, 27 bp, Artificial Sequence
  ARev_10_GCGTAA_A-ov
attacgcatctcgtatgccgtcttctg

SEQ ID NO: 467 - DNA, 27 bp, Artificial Sequence
  ARev_11_CGCTAA_A-ov
attagcgatctcgtatgccgtcttctg

SEQ ID NO: 468 - DNA, 27 bp, Artificial Sequence
  ARev_12_CGAAGA_A-ov
atcttcgatctcgtatgccgtcttctg

SEQ ID NO: 469 - DNA, 27 bp, Artificial Sequence
  ARev_13_GAGAGA_A-ov
atctctcatctcgtatgccgtcttctg

SEQ ID NO: 470 - DNA, 27 bp, Artificial Sequence
  ARev_14_TCCAGA_A-ov
atctggaatctcgtatgccgtcttctg

SEQ ID NO: 471 - DNA, 27 bp, Artificial Sequence
  ARev_15_AGTGGA_A-ov
atccactatctcgtatgccgtcttctg

SEQ ID NO: 472 - DNA, 27 bp, Artificial Sequence
  ARev_16_GTACGA_A-ov
atcgtacatctcgtatgccgtcttctg

SEQ ID NO: 473 - DNA, 27 bp, Artificial Sequence
  ARev_17_CATCGA_A-ov
atcgatgatctcgtatgccgtcttctg

SEQ ID NO: 474 - DNA, 27 bp, Artificial Sequence
  ARev_18_CTGTGA_A-ov
atcacagatctcgtatgccgtcttctg

SEQ ID NO: 475 - DNA, 27 bp, Artificial Sequence
  ARev_19_GCAACA_A-ov
atgttgcatctcgtatgccgtcttctg

SEQ ID NO: 476 - DNA, 27 bp, Artificial Sequence
  ARev_20_TGGACA_A-ov
atgtccaatctcgtatgccgtcttctg

SEQ ID NO: 477 - DNA, 27 bp, Artificial Sequence
  ARev_21_CACACA_A-ov
atgtgtgatctcgtatgccgtcttctg

SEQ ID NO: 478 - DNA, 27 bp, Artificial Sequence
  ARev_22_CTAGCA_A-ov
atgctagatctcgtatgccgtcttctg

SEQ ID NO: 479 - DNA, 27 bp, Artificial Sequence
  ARev_23_GATGCA_A-ov
atgcatcatctcgtatgccgtcttctg

SEQ ID NO: 480 - DNA, 27 bp, Artificial Sequence
  ARev_24_ACTCCA_A-ov
atggagtatctcgtatgccgtcttctg

SEQ ID NO: 481 - DNA, 27 bp, Artificial Sequence
  ARev_25_GTCTCA_A-ov
atgagacatctcgtatgccgtcttctg

SEQ ID NO: 482 - DNA, 27 bp, Artificial Sequence
  ARev_26_CCGATA_A-ov
atatcggatctcgtatgccgtcttctg

SEQ ID NO: 483 - DNA, 27 bp, Artificial Sequence
  ARev_27_GGCATA_A-ov
atatgccatctcgtatgccgtcttctg

SEQ ID NO: 484 - DNA, 27 bp, Artificial Sequence
  ARev_28_GTGGTA_A-ov
ataccacatctcgtatgccgtcttctg

SEQ ID NO: 485 - DNA, 27 bp, Artificial Sequence
  ARev_29_CTCCTA_A-ov
ataggagatctcgtatgccgtcttctg

SEQ ID NO: 486 - DNA, 27 bp, Artificial Sequence
  ARev_30_ACGAAG_A-ov
acttcgtatctcgtatgccgtcttctg

SEQ ID NO: 487 - DNA, 27 bp, Artificial Sequence
  ARev_31_TGCAAG_A-ov
acttgcaatctcgtatgccgtcttctg

SEQ ID NO: 488 - DNA, 27 bp, Artificial Sequence
  ARev_32_TCAGAG_A-ov
actctgaatctcgtatgccgtcttctg

SEQ ID NO: 489 - DNA, 27 bp, Artificial Sequence
  ARev_33_GTTGAG_A-ov
actcaacatctcgtatgccgtcttctg

SEQ ID NO: 490 - DNA, 27 bp, Artificial Sequence
  ARev_34_TAGCAG_A-ov
actgctaatctcgtatgccgtcttctg

SEQ ID NO: 491 - DNA, 27 bp, Artificial Sequence
  ARev_35_ATCCAG_A-ov
actggatatctcgtatgccgtcttctg

SEQ ID NO: 492 - DNA, 27 bp, Artificial Sequence
  ARev_36_CCTTAG_A-ov
actaaggatctcgtatgccgtcttctg

SEQ ID NO: 493 - DNA, 27 bp, Artificial Sequence
  ARev_37_TTGAGG_A-ov
acctcaaatctcgtatgccgtcttctg

SEQ ID NO: 494 - DNA, 27 bp, Artificial Sequence
  ARev_38_AACAGG_A-ov
acctgttatctcgtatgccgtcttctg

SEQ ID NO: 495 - DNA, 27 bp, Artificial Sequence
  ARev_39_GAATGG_A-ov
accattcatctcgtatgccgtcttctg

SEQ ID NO: 496 - DNA, 27 bp, Artificial Sequence
  ARev_40_AGAACG_A-ov
acgttctatctcgtatgccgtcttctg

SEQ ID NO: 497 - DNA, 27 bp, Artificial Sequence
  ARev_41_TCTACG_A-ov
acgtagaatctcgtatgccgtcttctg

SEQ ID NO: 498 - DNA, 27 bp, Artificial Sequence
  ARev_42_TTACCG_A-ov
acggtaaatctcgtatgccgtcttctg

SEQ ID NO: 499 - DNA, 27 bp, Artificial Sequence
  ARev_43_AAGTCG_A-ov
acgacttatctcgtatgccgtcttctg

SEQ ID NO: 500 - DNA, 27 bp, Artificial Sequence
  ARev_44_CGTATG_A-ov
acatacgatctcgtatgccgtcttctg

SEQ ID NO: 501 - DNA, 27 bp, Artificial Sequence
  ARev_45_CAAGTG_A-ov
acacttgatctcgtatgccgtcttctg

SEQ ID NO: 502 - DNA, 27 bp, Artificial Sequence
  ARev_46_TTCGTG_A-ov
acacgaaatctcgtatgccgtcttctg

SEQ ID NO: 503 - DNA, 27 bp, Artificial Sequence
  ARev_47_ACTGTG_A-ov
acacagtatctcgtatgccgtcttctg

SEQ ID NO: 504 - DNA, 27 bp, Artificial Sequence
  ARev_48_GATCTG_A-ov
acagatcatctcgtatgccgtcttctg

SEQ ID NO: 505 - DNA, 27 bp, Artificial Sequence
  ARev_49_TCGTTG_A-ov
acaacgaatctcgtatgccgtcttctg

SEQ ID NO: 506 - DNA, 27 bp, Artificial Sequence
  ARev_50_AGCTTG_A-ov
acaagctatctcgtatgccgtcttctg

SEQ ID NO: 507 - DNA, 27 bp, Artificial Sequence
  ARev_51_GTGAAC_A-ov
agttcacatctcgtatgccgtcttctg

SEQ ID NO: 508 - DNA, 27 bp, Artificial Sequence
  ARev_52_TACGAC_A-ov
agtcgtaatctcgtatgccgtcttctg

SEQ ID NO: 509 - DNA, 27 bp, Artificial Sequence
  ARev_53_TGACAC_A-ov
agtgtcaatctcgtatgccgtcttctg

SEQ ID NO: 510 - DNA, 27 bp, Artificial Sequence
  ARev_54_CTTCAC_A-ov
agtgaagatctcgtatgccgtcttctg

SEQ ID NO: 511 - DNA, 27 bp, Artificial Sequence
  ARev_55_GGTTAC_A-ov
agtaaccatctcgtatgccgtcttctg

SEQ ID NO: 512 - DNA, 27 bp, Artificial Sequence
  ARev_56_ACAAGC_A-ov
agcttgtatctcgtatgccgtcttctg

SEQ ID NO: 513 - DNA, 27 bp, Artificial Sequence
  ARev_57_TTAGGC_A-ov
agcctaaatctcgtatgccgtcttctg

SEQ ID NO: 514 - DNA, 27 bp, Artificial Sequence
  ARev_58_TAGTGC_A-ov
agcactaatctcgtatgccgtcttctg

SEQ ID NO: 515 - DNA, 27 bp, Artificial Sequence
  ARev_59_ATCTGC_A-ov
agcagatatctcgtatgccgtcttctg

SEQ ID NO: 516 - DNA, 27 bp, Artificial Sequence
  ARev_60_TTCACC_A-ov
aggtgaaatctcgtatgccgtcttctg

SEQ ID NO: 517 - DNA, 27 bp, Artificial Sequence
  ARev_61_ATTGCC_A-ov
aggcaatatctcgtatgccgtcttctg

SEQ ID NO: 518 - DNA, 27 bp, Artificial Sequence
  ARev_62_TCATCC_A-ov
aggatgaatctcgtatgccgtcttctg

SEQ ID NO: 519 - DNA, 27 bp, Artificial Sequence
  ARev_63_CATTCC_A-ov
aggaatgatctcgtatgccgtcttctg

SEQ ID NO: 520 - DNA, 27 bp, Artificial Sequence
  ARev_64_AGGATC_A-ov
agatcctatctcgtatgccgtcttctg

SEQ ID NO: 521 - DNA, 27 bp, Artificial Sequence
  ARev_65_GCTATC_A-ov
agatagcatctcgtatgccgtcttctg

SEQ ID NO: 522 - DNA, 27 bp, Artificial Sequence
  ARev_66_TGTGTC_A-ov
agacacaatctcgtatgccgtcttctg

SEQ ID NO: 523 - DNA, 27 bp, Artificial Sequence
  ARev_67_TTGCTC_A-ov
agagcaaatctcgtatgccgtcttctg

SEQ ID NO: 524 - DNA, 27 bp, Artificial Sequence
  ARev_68_AACCTC_A-ov
agaggttatctcgtatgccgtcttctg

SEQ ID NO: 525 - DNA, 27 bp, Artificial Sequence
  ARev_69_CGGAAT_A-ov
aattccgatctcgtatgccgtcttctg

SEQ ID NO: 526 - DNA, 27 bp, Artificial Sequence
  ARev_70_GCCAAT_A-ov
aattggcatctcgtatgccgtcttctg

SEQ ID NO: 527 - DNA, 27 bp, Artificial Sequence
  ARev_71_CTCGAT_A-ov
aatcgagatctcgtatgccgtcttctg

SEQ ID NO: 528 - DNA, 27 bp, Artificial Sequence
  ARev_72_GGTAGT_A-ov
aactaccatctcgtatgccgtcttctg

SEQ ID NO: 529 - DNA, 27 bp, Artificial Sequence
  ARev_73_TCTGGT_A-ov
aaccagaatctcgtatgccgtcttctg

SEQ ID NO: 530 - DNA, 27 bp, Artificial Sequence
  ARev_74_AGACGT_A-ov
aacgtctatctcgtatgccgtcttctg

SEQ ID NO: 531 - DNA, 27 bp, Artificial Sequence
  ARev_75_ACGTGT_A-ov
aacacgtatctcgtatgccgtcttctg

SEQ ID NO: 532 - DNA, 27 bp, Artificial Sequence
  ARev_76_CACTGT_A-ov
aacagtgatctcgtatgccgtcttctg

SEQ ID NO: 533 - DNA, 27 bp, Artificial Sequence
  ARev_77_ACAGCT_A-ov
aagctgtatctcgtatgccgtcttctg

SEQ ID NO: 534 - DNA, 27 bp, Artificial Sequence
  ARev_78_TAGGCT_A-ov
aagcctaatctcgtatgccgtcttctg

SEQ ID NO: 535 - DNA, 27 bp, Artificial Sequence
  ARev_79_GAACCT_A-ov
aaggttcatctcgtatgccgtcttctg

SEQ ID NO: 536 - DNA, 27 bp, Artificial Sequence
  ARev_80_ATGCCT_A-ov
aaggcatatctcgtatgccgtcttctg

SEQ ID NO: 537 - DNA, 27 bp, Artificial Sequence
  ARev_81_TGTCCT_A-ov
aaggacaatctcgtatgccgtcttctg

SEQ ID NO: 538 - DNA, 27 bp, Artificial Sequence
  ARev_82_GCTTCT_A-ov
aagaagcatctcgtatgccgtcttctg

SEQ ID NO: 539 - DNA, 27 bp, Artificial Sequence
  ARev_83_GACGTT_A-ov
aaacgtcatctcgtatgccgtcttctg

SEQ ID NO: 540 - DNA, 27 bp, Artificial Sequence
  ARev_84_CAGCTT_A-ov
aaagctgatctcgtatgccgtcttctg

SEQ ID NO: 541 - DNA, 27 bp, Artificial Sequence
  ARev_85_TACTCG_A-ov
acgagtaatctcgtatgccgtcttctg

SEQ ID NO: 542 - DNA, 27 bp, Artificial Sequence
  ARev_86_GGATTC_A-ov
agaatccatctcgtatgccgtcttctg

SEQ ID NO: 543 - DNA, 27 bp, Artificial Sequence
  ARev_87_CCATTC_A-ov
agaatggatctcgtatgccgtcttctg

SEQ ID NO: 544 - DNA, 27 bp, Artificial Sequence
  ARev_88_GCACTT_A-ov
aaagtgcatctcgtatgccgtcttctg

SEQ ID NO: 545 - DNA, 27 bp, Artificial Sequence
  ARev_89_CCTCTT_A-ov
aaagaggatctcgtatgccgtcttctg

SEQ ID NO: 546 - DNA, 27 bp, Artificial Sequence
  ARev_90_CCTGTA_A-ov
atacaggatctcgtatgccgtcttctg

SEQ ID NO: 547 - DNA, 27 bp, Artificial Sequence
  ARev_91_AGTCAG_A-ov
actgactatctcgtatgccgtcttctg

SEQ ID NO: 548 - DNA, 27 bp, Artificial Sequence
  ARev_92_GACTAG_A-ov
actagtcatctcgtatgccgtcttctg

SEQ ID NO: 549 - DNA, 27 bp, Artificial Sequence
  ARev_93_CTTAGG_A-ov
acctaagatctcgtatgccgtcttctg

SEQ ID NO: 550 - DNA, 27 bp, Artificial Sequence
  ARev_94_CTATGG_A-ov
accatagatctcgtatgccgtcttctg

SEQ ID NO: 551 - DNA, 27 bp, Artificial Sequence
  ARev_95_GTTACG_A-ov
acgtaacatctcgtatgccgtcttctg

SEQ ID NO: 552 - DNA, 27 bp, Artificial Sequence
  ARev_96_GCATTG_A-ov
acaatgcatctcgtatgccgtcttctg

SEQ ID NO: 553 - DNA, 27 bp, Artificial Sequence
  ARev_1_TTCCGT_C-ov
cacggaaatctcgtatgccgtcttctg

SEQ ID NO: 554 - DNA, 27 bp, Artificial Sequence
  ARev_2_TGTTGG_C-ov
cccaacaatctcgtatgccgtcttctg

SEQ ID NO: 555 - DNA, 27 bp, Artificial Sequence
  ARev_3_CGATCT_C-ov
cagatcgatctcgtatgccgtcttctg

SEQ ID NO: 556 - DNA, 27 bp, Artificial Sequence
  ARev_4_GGAGAA_C-ov
cttctccatctcgtatgccgtcttctg

SEQ ID NO: 557 - DNA, 27 bp, Artificial Sequence
  ARev_5_CAGGAA_C-ov
cttcctgatctcgtatgccgtcttctg

SEQ ID NO: 558 - DNA, 27 bp, Artificial Sequence
  ARev_6_ACCGAA_C-ov
cttcggtatctcgtatgccgtcttctg

SEQ ID NO: 559 - DNA, 27 bp, Artificial Sequence
  ARev_7_CCACAA_C-ov
cttgtggatctcgtatgccgtcttctg

SEQ ID NO: 560 - DNA, 27 bp, Artificial Sequence
  ARev_8_AGGCAA_C-ov
cttgcctatctcgtatgccgtcttctg

SEQ ID NO: 561 - DNA, 27 bp, Artificial Sequence
  ARev_9_GACCAA_C-ov
cttggtcatctcgtatgccgtcttctg

SEQ ID NO: 562 - DNA, 27 bp, Artificial Sequence
  ARev_10_GCGTAA_C-ov
cttacgcatctcgtatgccgtcttctg

SEQ ID NO: 563 - DNA, 27 bp, Artificial Sequence
  ARev_11_CGCTAA_C-ov
cttagcgatctcgtatgccgtcttctg

SEQ ID NO: 564 - DNA, 27 bp, Artificial Sequence
  ARev_12_CGAAGA_C-ov
ctcttcgatctcgtatgccgtcttctg

SEQ ID NO: 565 - DNA, 27 bp, Artificial Sequence
  ARev_13_GAGAGA_C-ov
ctctctcatctcgtatgccgtcttctg

SEQ ID NO: 566 - DNA, 27 bp, Artificial Sequence
  ARev_14_TCCAGA_C-ov
ctctggaatctcgtatgccgtcttctg

SEQ ID NO: 567 - DNA, 27 bp, Artificial Sequence
  ARev_15_AGTGGA_C-ov
ctccactatctcgtatgccgtcttctg

SEQ ID NO: 568 - DNA, 27 bp, Artificial Sequence
  ARev_16_GTACGA_C-ov
ctcgtacatctcgtatgccgtcttctg

SEQ ID NO: 569 - DNA, 27 bp, Artificial Sequence
  ARev_17_CATCGA_C-ov
ctcgatgatctcgtatgccgtcttctg

SEQ ID NO: 570 - DNA, 27 bp, Artificial Sequence
  ARev_18_CTGTGA_C-ov
ctcacagatctcgtatgccgtcttctg

SEQ ID NO: 571 - DNA, 27 bp, Artificial Sequence
  ARev_19_GCAACA_C-ov
ctgttgcatctcgtatgccgtcttctg

SEQ ID NO: 572 - DNA, 27 bp, Artificial Sequence
  ARev_20_TGGACA_C-ov
ctgtccaatctcgtatgccgtcttctg

SEQ ID NO: 573 - DNA, 27 bp, Artificial Sequence
  ARev_21_CACACA_C-ov
ctgtgtgatctcgtatgccgtcttctg

SEQ ID NO: 574 - DNA, 27 bp, Artificial Sequence
  ARev_22_CTAGCA_C-ov
ctgctagatctcgtatgccgtcttctg

SEQ ID NO: 575 - DNA, 27 bp, Artificial Sequence
  ARev_23_GATGCA_C-ov
ctgcatcatctcgtatgccgtcttctg

SEQ ID NO: 576 - DNA, 27 bp, Artificial Sequence
  ARev_24_ACTCCA_C-ov
ctggagtatctcgtatgccgtcttctg

SEQ ID NO: 577 - DNA, 27 bp, Artificial Sequence
  ARev_25_GTCTCA_C-ov
ctgagacatctcgtatgccgtcttctg

SEQ ID NO: 578 - DNA, 27 bp, Artificial Sequence
  ARev_26_CCGATA_C-ov
ctatcggatctcgtatgccgtcttctg

SEQ ID NO: 579 - DNA, 27 bp, Artificial Sequence
  ARev_27_GGCATA_C-ov
ctatgccatctcgtatgccgtcttctg

SEQ ID NO: 580 - DNA, 27 bp, Artificial Sequence
  ARev_28_GTGGTA_C-ov
ctaccacatctcgtatgccgtcttctg

SEQ ID NO: 581 - DNA, 27 bp, Artificial Sequence
  ARev_29_CTCCTA_C-ov
ctaggagatctcgtatgccgtcttctg

SEQ ID NO: 582 - DNA, 27 bp, Artificial Sequence
  ARev_30_ACGAAG_C-ov
ccttcgtatctcgtatgccgtcttctg

SEQ ID NO: 583 - DNA, 27 bp, Artificial Sequence
  ARev_31_TGCAAG_C-ov
ccttgcaatctcgtatgccgtcttctg

SEQ ID NO: 584 - DNA, 27 bp, Artificial Sequence
  ARev_32_TCAGAG_C-ov
cctctgaatctcgtatgccgtcttctg

SEQ ID NO: 585 - DNA, 27 bp, Artificial Sequence
  ARev_33_GTTGAG_C-ov
cctcaacatctcgtatgccgtcttctg

SEQ ID NO: 586 - DNA, 27 bp, Artificial Sequence
  ARev_34_TAGCAG_C-ov
cctgctaatctcgtatgccgtcttctg

SEQ ID NO: 587 - DNA, 27 bp, Artificial Sequence
  ARev_35_ATCCAG_C-ov
cctggatatctcgtatgccgtcttctg

SEQ ID NO: 588 - DNA, 27 bp, Artificial Sequence
  ARev_36_CCTTAG_C-ov
cctaaggatctcgtatgccgtcttctg

SEQ ID NO: 589 - DNA, 27 bp, Artificial Sequence
  ARev_37_TTGAGG_C-ov
ccctcaaatctcgtatgccgtcttctg

SEQ ID NO: 590 - DNA, 27 bp, Artificial Sequence
  ARev_38_AACAGG_C-ov
ccctgttatctcgtatgccgtcttctg

SEQ ID NO: 591 - DNA, 27 bp, Artificial Sequence
  ARev_39_GAATGG_C-ov
cccattcatctcgtatgccgtcttctg

SEQ ID NO: 592 - DNA, 27 bp, Artificial Sequence
  ARev_40_AGAACG_C-ov
ccgttctatctcgtatgccgtcttctg

SEQ ID NO: 593 - DNA, 27 bp, Artificial Sequence
  ARev_41_TCTACG_C-ov
ccgtagaatctcgtatgccgtcttctg

SEQ ID NO: 594 - DNA, 27 bp, Artificial Sequence
  ARev_42_TTACCG_C-ov
ccggtaaatctcgtatgccgtcttctg

SEQ ID NO: 595 - DNA, 27 bp, Artificial Sequence
  ARev_43_AAGTCG_C-ov
ccgacttatctcgtatgccgtcttctg

SEQ ID NO: 596 - DNA, 27 bp, Artificial Sequence
  ARev_44_CGTATG_C-ov
ccatacgatctcgtatgccgtcttctg

SEQ ID NO: 597 - DNA, 27 bp, Artificial Sequence
  ARev_45_CAAGTG_C-ov
ccacttgatctcgtatgccgtcttctg

SEQ ID NO: 598 - DNA, 27 bp, Artificial Sequence
  ARev_46_TTCGTG_C-ov
ccacgaaatctcgtatgccgtcttctg

SEQ ID NO: 599 - DNA, 27 bp, Artificial Sequence
  ARev_47_ACTGTG_C-ov
ccacagtatctcgtatgccgtcttctg

SEQ ID NO: 600 - DNA, 27 bp, Artificial Sequence
  ARev_48_GATCTG_C-ov
ccagatcatctcgtatgccgtcttctg

SEQ ID NO: 601 - DNA, 27 bp, Artificial Sequence
  ARev_49_TCGTTG_C-ov
ccaacgaatctcgtatgccgtcttctg

SEQ ID NO: 602 - DNA, 27 bp, Artificial Sequence
  ARev_50_AGCTTG_C-ov
ccaagctatctcgtatgccgtcttctg

SEQ ID NO: 603 - DNA, 27 bp, Artificial Sequence
  ARev_51_GTGAAC_C-ov
cgttcacatctcgtatgccgtcttctg

SEQ ID NO: 604 - DNA, 27 bp, Artificial Sequence
  ARev_52_TACGAC_C-ov
cgtcgtaatctcgtatgccgtcttctg

SEQ ID NO: 605 - DNA, 27 bp, Artificial Sequence
  ARev_53_TGACAC_C-ov
cgtgtcaatctcgtatgccgtcttctg

SEQ ID NO: 606 - DNA, 27 bp, Artificial Sequence
  ARev_54_CTTCAC_C-ov
cgtgaagatctcgtatgccgtcttctg

SEQ ID NO: 607 - DNA, 27 bp, Artificial Sequence
  ARev_55_GGTTAC_C-ov
cgtaaccatctcgtatgccgtcttctg

SEQ ID NO: 608 - DNA, 27 bp, Artificial Sequence
  ARev_56_ACAAGC_C-ov
cgcttgtatctcgtatgccgtcttctg

SEQ ID NO: 609 - DNA, 27 bp, Artificial Sequence
  ARev_57_TTAGGC_C-ov
cgcctaaatctcgtatgccgtcttctg

SEQ ID NO: 610 - DNA, 27 bp, Artificial Sequence
  ARev_58_TAGTGC_C-ov
cgcactaatctcgtatgccgtcttctg

SEQ ID NO: 611 - DNA, 27 bp, Artificial Sequence
  ARev_59_ATCTGC_C-ov
cgcagatatctcgtatgccgtcttctg

SEQ ID NO: 612 - DNA, 27 bp, Artificial Sequence
  ARev_60_TTCACC_C-ov
cggtgaaatctcgtatgccgtcttctg

SEQ ID NO: 613 - DNA, 27 bp, Artificial Sequence
  ARev_61_ATTGCC_C-ov
cggcaatatctcgtatgccgtcttctg

SEQ ID NO: 614 - DNA, 27 bp, Artificial Sequence
  ARev_62_TCATCC_C-ov
cggatgaatctcgtatgccgtcttctg

SEQ ID NO: 615 - DNA, 27 bp, Artificial Sequence
  ARev_63_CATTCC_C-ov
cggaatgatctcgtatgccgtcttctg

SEQ ID NO: 616 - DNA, 27 bp, Artificial Sequence
  ARev_64_AGGATC_C-ov
cgatcctatctcgtatgccgtcttctg

SEQ ID NO: 617 - DNA, 27 bp, Artificial Sequence
  ARev_65_GCTATC_C-ov
cgatagcatctcgtatgccgtcttctg

SEQ ID NO: 618 - DNA, 27 bp, Artificial Sequence
  ARev_66_TGTGTC_C-ov
cgacacaatctcgtatgccgtcttctg

SEQ ID NO: 619 - DNA, 27 bp, Artificial Sequence
  ARev_67_TTGCTC_C-ov
cgagcaaatctcgtatgccgtcttctg

SEQ ID NO: 620 - DNA, 27 bp, Artificial Sequence
  ARev_68_AACCTC_C-ov
cgaggttatctcgtatgccgtcttctg

SEQ ID NO: 621 - DNA, 27 bp, Artificial Sequence
  ARev_69_CGGAAT_C-ov
cattccgatctcgtatgccgtcttctg

SEQ ID NO: 622 - DNA, 27 bp, Artificial Sequence
  ARev_70_GCCAAT_C-ov
cattggcatctcgtatgccgtcttctg

SEQ ID NO: 623 - DNA, 27 bp, Artificial Sequence
  ARev_71_CTCGAT_C-ov
catcgagatctcgtatgccgtcttctg

SEQ ID NO: 624 - DNA, 27 bp, Artificial Sequence
  ARev_72_GGTAGT_C-ov
cactaccatctcgtatgccgtcttctg

SEQ ID NO: 625 - DNA, 27 bp, Artificial Sequence
  ARev_73_TCTGGT_C-ov
caccagaatctcgtatgccgtcttctg

SEQ ID NO: 626 - DNA, 27 bp, Artificial Sequence
  ARev_74_AGACGT_C-ov
cacgtctatctcgtatgccgtcttctg

SEQ ID NO: 627 - DNA, 27 bp, Artificial Sequence
  ARev_75_ACGTGT_C-ov
cacacgtatctcgtatgccgtcttctg

SEQ ID NO: 628 - DNA, 27 bp, Artificial Sequence
  ARev_76_CACTGT_C-ov
cacagtgatctcgtatgccgtcttctg

SEQ ID NO: 629 - DNA, 27 bp, Artificial Sequence
  ARev_77_ACAGCT_C-ov
cagctgtatctcgtatgccgtcttctg

SEQ ID NO: 630 - DNA, 27 bp, Artificial Sequence
  ARev_78_TAGGCT_C-ov
cagcctaatctcgtatgccgtcttctg

SEQ ID NO: 631 - DNA, 27 bp, Artificial Sequence
  ARev_79_GAACCT_C-ov
caggttcatctcgtatgccgtcttctg

SEQ ID NO: 632 - DNA, 27 bp, Artificial Sequence
  ARev_80_ATGCCT_C-ov
caggcatatctcgtatgccgtcttctg

SEQ ID NO: 633 - DNA, 27 bp, Artificial Sequence
  ARev_81_TGTCCT_C-ov
caggacaatctcgtatgccgtcttctg

SEQ ID NO: 634 - DNA, 27 bp, Artificial Sequence
  ARev_82_GCTTCT_C-ov
cagaagcatctcgtatgccgtcttctg

SEQ ID NO: 635 - DNA, 27 bp, Artificial Sequence
  ARev_83_GACGTT_C-ov
caacgtcatctcgtatgccgtcttctg

SEQ ID NO: 636 - DNA, 27 bp, Artificial Sequence
  ARev_84_CAGCTT_C-ov
caagctgatctcgtatgccgtcttctg

SEQ ID NO: 637 - DNA, 27 bp, Artificial Sequence
  ARev_85_TACTCG_C-ov
ccgagtaatctcgtatgccgtcttctg

SEQ ID NO: 638 - DNA, 27 bp, Artificial Sequence
  ARev_86_GGATTC_C-ov
cgaatccatctcgtatgccgtcttctg

SEQ ID NO: 639 - DNA, 27 bp, Artificial Sequence
  ARev_87_CCATTC_C-ov
cgaatggatctcgtatgccgtcttctg

SEQ ID NO: 640 - DNA, 27 bp, Artificial Sequence
  ARev_88_GCACTT_C-ov
caagtgcatctcgtatgccgtcttctg

SEQ ID NO: 641 - DNA, 27 bp, Artificial Sequence
  ARev_89_CCTCTT_C-ov
caagaggatctcgtatgccgtcttctg

SEQ ID NO: 642 - DNA, 27 bp, Artificial Sequence
  ARev_90_CCTGTA_C-ov
ctacaggatctcgtatgccgtcttctg

SEQ ID NO: 643 - DNA, 27 bp, Artificial Sequence
  ARev_91_AGTCAG_C-ov
cctgactatctcgtatgccgtcttctg

SEQ ID NO: 644 - DNA, 27 bp, Artificial Sequence
  ARev_92_GACTAG_C-ov
cctagtcatctcgtatgccgtcttctg

SEQ ID NO: 645 - DNA, 27 bp, Artificial Sequence
  ARev_93_CTTAGG_C-ov
ccctaagatctcgtatgccgtcttctg

SEQ ID NO: 646 - DNA, 27 bp, Artificial Sequence
  ARev_94_CTATGG_C-ov
cccatagatctcgtatgccgtcttctg

SEQ ID NO: 647 - DNA, 27 bp, Artificial Sequence
  ARev_95_GTTACG_C-ov
ccgtaacatctcgtatgccgtcttctg

SEQ ID NO: 648 - DNA, 27 bp, Artificial Sequence
  ARev_96_GCATTG_C-ov
ccaatgcatctcgtatgccgtcttctg

SEQ ID NO: 649 - DNA, 27 bp, Artificial Sequence
  ARev_1_TTCCGT_T-ov
tacggaaatctcgtatgccgtcttctg

SEQ ID NO: 650 - DNA, 27 bp, Artificial Sequence
  ARev_2_TGTTGG_T-ov
tccaacaatctcgtatgccgtcttctg

SEQ ID NO: 651 - DNA, 27 bp, Artificial Sequence
  ARev_3_TGATCT_T-ov
tagatcgatctcgtatgccgtcttctg

SEQ ID NO: 652 - DNA, 27 bp, Artificial Sequence
  ARev_4_GGAGAA_T-ov
tttctccatctcgtatgccgtcttctg

SEQ ID NO: 653 - DNA, 27 bp, Artificial Sequence
  ARev_5_TAGGAA_T-ov
tttcctgatctcgtatgccgtcttctg

SEQ ID NO: 654 - DNA, 27 bp, Artificial Sequence
  ARev_6_ACCGAA_T-ov
tttcggtatctcgtatgccgtcttctg

SEQ ID NO: 655 - DNA, 27 bp, Artificial Sequence
  ARev_7_TCACAA_T-ov
tttgtggatctcgtatgccgtcttctg

SEQ ID NO: 656 - DNA, 27 bp, Artificial Sequence
  ARev_8_AGGCAA_T-ov
tttgcctatctcgtatgccgtcttctg

SEQ ID NO: 657 - DNA, 27 bp, Artificial Sequence
  ARev_9_GACCAA_T-ov
tttggtcatctcgtatgccgtcttctg

SEQ ID NO: 658 - DNA, 27 bp, Artificial Sequence
  ARev_10_GCGTAA_T-ov
tttacgcatctcgtatgccgtcttctg

SEQ ID NO: 659 - DNA, 27 bp, Artificial Sequence
  ARev_11_TGCTAA_T-ov
tttagcgatctcgtatgccgtcttctg

SEQ ID NO: 660 - DNA, 27 bp, Artificial Sequence
  ARev_12_TGAAGA_T-ov
ttcttcgatctcgtatgccgtcttctg

SEQ ID NO: 661 - DNA, 27 bp, Artificial Sequence
  ARev_13_GAGAGA_T-ov
ttctctcatctcgtatgccgtcttctg

SEQ ID NO: 662 - DNA, 27 bp, Artificial Sequence
  ARev_14_TCCAGA_T-ov
ttctggaatctcgtatgccgtcttctg

SEQ ID NO: 663 - DNA, 27 bp, Artificial Sequence
  ARev_15_AGTGGA_T-ov
ttccactatctcgtatgccgtcttctg

SEQ ID NO: 664 - DNA, 27 bp, Artificial Sequence
  ARev_16_GTACGA_T-ov
ttcgtacatctcgtatgccgtcttctg

SEQ ID NO: 665 - DNA, 27 bp, Artificial Sequence
  ARev_17_TATCGA_T-ov
ttcgatgatctcgtatgccgtcttctg

SEQ ID NO: 666 - DNA, 27 bp, Artificial Sequence
  ARev_18_TTGTGA_T-ov
ttcacagatctcgtatgccgtcttctg

SEQ ID NO: 667 - DNA, 27 bp, Artificial Sequence
  ARev_19_GCAACA_T-ov
ttgttgcatctcgtatgccgtcttctg

SEQ ID NO: 668 - DNA, 27 bp, Artificial Sequence
  ARev_20_TGGACA_T-ov
ttgtccaatctcgtatgccgtcttctg

SEQ ID NO: 669 - DNA, 27 bp, Artificial Sequence
  ARev_21_TACACA_T-ov
ttgtgtgatctcgtatgccgtcttctg

SEQ ID NO: 670 - DNA, 27 bp, Artificial Sequence
  ARev_22_TTAGCA_T-ov
ttgctagatctcgtatgccgtcttctg

SEQ ID NO: 671 - DNA, 27 bp, Artificial Sequence
  ARev_23_GATGCA_T-ov
ttgcatcatctcgtatgccgtcttctg

SEQ ID NO: 672 - DNA, 27 bp, Artificial Sequence
  ARev_24_ACTCCA_T-ov
ttggagtatctcgtatgccgtcttctg

SEQ ID NO: 673 - DNA, 27 bp, Artificial Sequence
  ARev_25_GTCTCA_T-ov
ttgagacatctcgtatgccgtcttctg

SEQ ID NO: 674 - DNA, 27 bp, Artificial Sequence
  ARev_26_TCGATA_T-ov
ttatcggatctcgtatgccgtcttctg

SEQ ID NO: 675 - DNA, 27 bp, Artificial Sequence
  ARev_27_GGCATA_T-ov
ttatgccatctcgtatgccgtcttctg

SEQ ID NO: 676 - DNA, 27 bp, Artificial Sequence
  ARev_28_GTGGTA_T-ov
ttaccacatctcgtatgccgtcttctg

SEQ ID NO: 677 - DNA, 27 bp, Artificial Sequence
  ARev_29_TTCCTA_T-ov
ttaggagatctcgtatgccgtcttctg

SEQ ID NO: 678 - DNA, 27 bp, Artificial Sequence
  ARev_30_ACGAAG_T-ov
tcttcgtatctcgtatgccgtcttctg

SEQ ID NO: 679 - DNA, 27 bp, Artificial Sequence
  ARev_31_TGCAAG_T-ov
tcttgcaatctcgtatgccgtcttctg

SEQ ID NO: 680 - DNA, 27 bp, Artificial Sequence
  ARev_32_TCAGAG_T-ov
tctctgaatctcgtatgccgtcttctg

SEQ ID NO: 681 - DNA, 27 bp, Artificial Sequence
  ARev_33_GTTGAG_T-ov
tctcaacatctcgtatgccgtcttctg

SEQ ID NO: 682 - DNA, 27 bp, Artificial Sequence
  ARev_34_TAGCAG_T-ov
tctgctaatctcgtatgccgtcttctg

SEQ ID NO: 683 - DNA, 27 bp, Artificial Sequence
  ARev_35_ATCCAG_T-ov
tctggatatctcgtatgccgtcttctg

SEQ ID NO: 684 - DNA, 27 bp, Artificial Sequence
  ARev_36_TCTTAG_T-ov
tctaaggatctcgtatgccgtcttctg

SEQ ID NO: 685 - DNA, 27 bp, Artificial Sequence
  ARev_37_TTGAGG_T-ov
tcctcaaatctcgtatgccgtcttctg

SEQ ID NO: 686 - DNA, 27 bp, Artificial Sequence
  ARev_38_AACAGG_T-ov
tcctgttatctcgtatgccgtcttctg

SEQ ID NO: 687 - DNA, 27 bp, Artificial Sequence
  ARev_39_GAATGG_T-ov
tccattcatctcgtatgccgtcttctg

SEQ ID NO: 688 - DNA, 27 bp, Artificial Sequence
  ARev_40_AGAACG_T-ov
tcgttctatctcgtatgccgtcttctg

SEQ ID NO: 689 - DNA, 27 bp, Artificial Sequence
  ARev_41_TCTACG_T-ov
tcgtagaatctcgtatgccgtcttctg

SEQ ID NO: 690 - DNA, 27 bp, Artificial Sequence
  ARev_42_TTACCG_T-ov
tcggtaaatctcgtatgccgtcttctg

SEQ ID NO: 691 - DNA, 27 bp, Artificial Sequence
  ARev_43_AAGTCG_T-ov
tcgacttatctcgtatgccgtcttctg

SEQ ID NO: 692 - DNA, 27 bp, Artificial Sequence
  ARev_44_TGTATG_T-ov
tcatacgatctcgtatgccgtcttctg

SEQ ID NO: 693 - DNA, 27 bp, Artificial Sequence
  ARev_45_TAAGTG_T-ov
tcacttgatctcgtatgccgtcttctg

SEQ ID NO: 694 - DNA, 27 bp, Artificial Sequence
  ARev_46_TTCGTG_T-ov
tcacgaaatctcgtatgccgtcttctg

SEQ ID NO: 695 - DNA, 27 bp, Artificial Sequence
  ARev_47_ACTGTG_T-ov
tcacagtatctcgtatgccgtcttctg

SEQ ID NO: 696 - DNA, 27 bp, Artificial Sequence
  ARev_48_GATCTG_T-ov
tcagatcatctcgtatgccgtcttctg

SEQ ID NO: 697 - DNA, 27 bp, Artificial Sequence
  ARev_49_TCGTTG_T-ov
tcaacgaatctcgtatgccgtcttctg

SEQ ID NO: 698 - DNA, 27 bp, Artificial Sequence
  ARev_50_AGCTTG_T-ov
tcaagctatctcgtatgccgtcttctg

SEQ ID NO: 699 - DNA, 27 bp, Artificial Sequence
  ARev_51_GTGAAC_T-ov
tgttcacatctcgtatgccgtcttctg

SEQ ID NO: 700 - DNA, 27 bp, Artificial Sequence
  ARev_52_TACGAC_T-ov
tgtcgtaatctcgtatgccgtcttctg

SEQ ID NO: 701 - DNA, 27 bp, Artificial Sequence
  ARev_53_TGACAC_T-ov
tgtgtcaatctcgtatgccgtcttctg

SEQ ID NO: 702 - DNA, 27 bp, Artificial Sequence
  ARev_54_TTTCAC_T-ov
tgtgaagatctcgtatgccgtcttctg

SEQ ID NO: 703 - DNA, 27 bp, Artificial Sequence
  ARev_55_GGTTAC_T-ov
tgtaaccatctcgtatgccgtcttctg

SEQ ID NO: 704 - DNA, 27 bp, Artificial Sequence
  ARev_56_ACAAGC_T-ov
tgcttgtatctcgtatgccgtcttctg

SEQ ID NO: 705 - DNA, 27 bp, Artificial Sequence
  ARev_57_TTAGGC_T-ov
tgcctaaatctcgtatgccgtcttctg

SEQ ID NO: 706 - DNA, 27 bp, Artificial Sequence
  ARev_58_TAGTGC_T-ov
tgcactaatctcgtatgccgtcttctg

SEQ ID NO: 707 - DNA, 27 bp, Artificial Sequence
  ARev_59_ATCTGC_T-ov
tgcagatatctcgtatgccgtcttctg

SEQ ID NO: 708 - DNA, 27 bp, Artificial Sequence
  ARev_60_TTCACC_T-ov
tggtgaaatctcgtatgccgtcttctg

SEQ ID NO: 709 - DNA, 27 bp, Artificial Sequence
  ARev_61_ATTGCC_T-ov
tggcaatatctcgtatgccgtcttctg

SEQ ID NO: 710 - DNA, 27 bp, Artificial Sequence
  ARev_62_TCATCC_T-ov
tggatgaatctcgtatgccgtcttctg

SEQ ID NO: 711 - DNA, 27 bp, Artificial Sequence
  ARev_63_TATTCC_T-ov
tggaatgatctcgtatgccgtcttctg

SEQ ID NO: 712 - DNA, 27 bp, Artificial Sequence
  ARev_64_AGGATC_T-ov
tgatcctatctcgtatgccgtcttctg

SEQ ID NO: 713 - DNA, 27 bp, Artificial Sequence
  ARev_65_GCTATC_T-ov
tgatagcatctcgtatgccgtcttctg

SEQ ID NO: 714 - DNA, 27 bp, Artificial Sequence
  ARev_66_TGTGTC_T-ov
tgacacaatctcgtatgccgtcttctg

SEQ ID NO: 715 - DNA, 27 bp, Artificial Sequence
  ARev_67_TTGCTC_T-ov
tgagcaaatctcgtatgccgtcttctg

SEQ ID NO: 716 - DNA, 27 bp, Artificial Sequence
  ARev_68_AACCTC_T-ov
tgaggttatctcgtatgccgtcttctg

SEQ ID NO: 717 - DNA, 27 bp, Artificial Sequence
  ARev_69_TGGAAT_T-ov
tattccgatctcgtatgccgtcttctg

SEQ ID NO: 718 - DNA, 27 bp, Artificial Sequence
  ARev_70_GCCAAT_T-ov
tattggcatctcgtatgccgtcttctg

SEQ ID NO: 719 - DNA, 27 bp, Artificial Sequence
  ARev_71_TTCGAT_T-ov
tatcgagatctcgtatgccgtcttctg

SEQ ID NO: 720 - DNA, 27 bp, Artificial Sequence
  ARev_72_GGTAGT_T-ov
tactaccatctcgtatgccgtcttctg

SEQ ID NO: 721 - DNA, 27 bp, Artificial Sequence
  ARev_73_TCTGGT_T-ov
taccagaatctcgtatgccgtcttctg

SEQ ID NO: 722 - DNA, 27 bp, Artificial Sequence
  ARev_74_AGACGT_T-ov
tacgtctatctcgtatgccgtcttctg

SEQ ID NO: 723 - DNA, 27 bp, Artificial Sequence
  ARev_75_ACGTGT_T-ov
tacacgtatctcgtatgccgtcttctg

SEQ ID NO: 724 - DNA, 27 bp, Artificial Sequence
  ARev_76_TACTGT_T-ov
tacagtgatctcgtatgccgtcttctg

SEQ ID NO: 725 - DNA, 27 bp, Artificial Sequence
  ARev_77_ACAGCT_T-ov
tagctgtatctcgtatgccgtcttctg

SEQ ID NO: 726 - DNA, 27 bp, Artificial Sequence
  ARev_78_TAGGCT_T-ov
tagcctaatctcgtatgccgtcttctg

SEQ ID NO: 727 - DNA, 27 bp, Artificial Sequence
  ARev_79_GAACCT_T-ov
taggttcatctcgtatgccgtcttctg

SEQ ID NO: 728 - DNA, 27 bp, Artificial Sequence
  ARev_80_ATGCCT_T-ov
taggcatatctcgtatgccgtcttctg

SEQ ID NO: 729 - DNA, 27 bp, Artificial Sequence
  ARev_81_TGTCCT_T-ov
taggacaatctcgtatgccgtcttctg

SEQ ID NO: 730 - DNA, 27 bp, Artificial Sequence
  ARev_82_GCTTCT_T-ov
tagaagcatctcgtatgccgtcttctg

SEQ ID NO: 731 - DNA, 27 bp, Artificial Sequence
  ARev_83_GACGTT_T-ov
taacgtcatctcgtatgccgtcttctg

SEQ ID NO: 732 - DNA, 27 bp, Artificial Sequence
  ARev_84_TAGCTT_T-ov
taagctgatctcgtatgccgtcttctg

SEQ ID NO: 733 - DNA, 27 bp, Artificial Sequence
  ARev_85_TACTCG_T-ov
tcgagtaatctcgtatgccgtcttctg

SEQ ID NO: 734 - DNA, 27 bp, Artificial Sequence
  ARev_86_GGATTC_T-ov
tgaatccatctcgtatgccgtcttctg

SEQ ID NO: 735 - DNA, 27 bp, Artificial Sequence
  ARev_87_TCATTC_T-ov
tgaatggatctcgtatgccgtcttctg

SEQ ID NO: 736 - DNA, 27 bp, Artificial Sequence
  ARev_88_GCACTT_T-ov
taagtgcatctcgtatgccgtcttctg

SEQ ID NO: 737 - DNA, 27 bp, Artificial Sequence
  ARev_89_TCTCTT_T-ov
taagaggatctcgtatgccgtcttctg

SEQ ID NO: 738 - DNA, 27 bp, Artificial Sequence
  ARev_90_TCTGTA_T-ov
ttacaggatctcgtatgccgtcttctg

SEQ ID NO: 739 - DNA, 27 bp, Artificial Sequence
  ARev_91_AGTCAG_T-ov
tctgactatctcgtatgccgtcttctg

SEQ ID NO: 740 - DNA, 27 bp, Artificial Sequence
  ARev_92_GACTAG_T-ov
tctagtcatctcgtatgccgtcttctg

SEQ ID NO: 741 - DNA, 27 bp, Artificial Sequence
  ARev_93_TTTAGG_T-ov
tcctaagatctcgtatgccgtcttctg

SEQ ID NO: 742 - DNA, 27 bp, Artificial Sequence
  ARev_94_TTATGG_T-ov
tccatagatctcgtatgccgtcttctg

SEQ ID NO: 743 - DNA, 27 bp, Artificial Sequence
  ARev_95_GTTACG_T-ov
tcgtaacatctcgtatgccgtcttctg

SEQ ID NO: 744 - DNA, 27 bp, Artificial Sequence
  ARev_96_GCATTG_T-ov
tcaatgcatctcgtatgccgtcttctg

SEQ ID NO: 745 - DNA, 27 bp, Artificial Sequence
  ARev_1_TTCCGT_G-ov
gacggaaatctcgtatgccgtcttctg

SEQ ID NO: 746 - DNA, 27 bp, Artificial Sequence
  ARev_2_TGTTGG_G-ov
gccaacaatctcgtatgccgtcttctg

SEQ ID NO: 747 - DNA, 27 bp, Artificial Sequence
  ARev_3_TGATCT_G-ov
gagatcgatctcgtatgccgtcttctg

SEQ ID NO: 748 - DNA, 27 bp, Artificial Sequence
  ARev_4_GGAGAA_G-ov
gttctccatctcgtatgccgtcttctg

SEQ ID NO: 749 - DNA, 27 bp, Artificial Sequence
  ARev_5_TAGGAA_G-ov
gttcctgatctcgtatgccgtcttctg

SEQ ID NO: 750 - DNA, 27 bp, Artificial Sequence
  ARev_6_ACCGAA_G-ov
gttcggtatctcgtatgccgtcttctg

SEQ ID NO: 751 - DNA, 27 bp, Artificial Sequence
  ARev_7_TCACAA_G-ov
gttgtggatctcgtatgccgtcttctg

SEQ ID NO: 752 - DNA, 27 bp, Artificial Sequence
  ARev_8_AGGCAA_G-ov
gttgcctatctcgtatgccgtcttctg

SEQ ID NO: 753 - DNA, 27 bp, Artificial Sequence
  ARev_9_GACCAA_G-ov
gttggtcatctcgtatgccgtcttctg

SEQ ID NO: 754 - DNA, 27 bp, Artificial Sequence
  ARev_10_GCGTAA_G-ov
gttacgcatctcgtatgccgtcttctg

SEQ ID NO: 755 - DNA, 27 bp, Artificial Sequence
  ARev_11_TGCTAA_G-ov
gttagcgatctcgtatgccgtcttctg

SEQ ID NO: 756 - DNA, 27 bp, Artificial Sequence
  ARev_12_TGAAGA_G-ov
gtcttcgatctcgtatgccgtcttctg

SEQ ID NO: 757 - DNA, 27 bp, Artificial Sequence
  ARev_13_GAGAGA_G-ov
gtctctcatctcgtatgccgtcttctg

SEQ ID NO: 758 - DNA, 27 bp, Artificial Sequence
  ARev_14_TCCAGA_G-ov
gtctggaatctcgtatgccgtcttctg

SEQ ID NO: 759 - DNA, 27 bp, Artificial Sequence
  ARev_15_AGTGGA_G-ov
gtccactatctcgtatgccgtcttctg

SEQ ID NO: 760 - DNA, 27 bp, Artificial Sequence
  ARev_16_GTACGA_G-ov
gtcgtacatctcgtatgccgtcttctg

SEQ ID NO: 761 - DNA, 27 bp, Artificial Sequence
  ARev_17_TATCGA_G-ov
gtcgatgatctcgtatgccgtcttctg

SEQ ID NO: 762 - DNA, 27 bp, Artificial Sequence
  ARev_18_TTGTGA_G-ov
gtcacagatctcgtatgccgtcttctg

SEQ ID NO: 763 - DNA, 27 bp, Artificial Sequence
  ARev_19_GCAACA_G-ov
gtgttgcatctcgtatgccgtcttctg

SEQ ID NO: 764 - DNA, 27 bp, Artificial Sequence
  ARev_20_TGGACA_G-ov
gtgtccaatctcgtatgccgtcttctg

SEQ ID NO: 765 - DNA, 27 bp, Artificial Sequence
  ARev_21_TACACA_G-ov
gtgtgtgatctcgtatgccgtcttctg

SEQ ID NO: 766 - DNA, 27 bp, Artificial Sequence
  ARev_22_TTAGCA_G-ov
gtgctagatctcgtatgccgtcttctg

SEQ ID NO: 767 - DNA, 27 bp, Artificial Sequence
  ARev_23_GATGCA_G-ov
gtgcatcatctcgtatgccgtcttctg

SEQ ID NO: 768 - DNA, 27 bp, Artificial Sequence
  ARev_24_ACTCCA_G-ov
gtggagtatctcgtatgccgtcttctg

SEQ ID NO: 769 - DNA, 27 bp, Artificial Sequence
  ARev_25_GTCTCA_G-ov
gtgagacatctcgtatgccgtcttctg

SEQ ID NO: 770 - DNA, 27 bp, Artificial Sequence
  ARev_26_TCGATA_G-ov
gtatcggatctcgtatgccgtcttctg

SEQ ID NO: 771 - DNA, 27 bp, Artificial Sequence
  ARev_27_GGCATA_G-ov
gtatgccatctcgtatgccgtcttctg

SEQ ID NO: 772 - DNA, 27 bp, Artificial Sequence
  ARev_28_GTGGTA_G-ov
gtaccacatctcgtatgccgtcttctg

SEQ ID NO: 773 - DNA, 27 bp, Artificial Sequence
  ARev_29_TTCCTA_G-ov
gtaggagatctcgtatgccgtcttctg

SEQ ID NO: 774 - DNA, 27 bp, Artificial Sequence
  ARev_30_ACGAAG_G-ov
gcttcgtatctcgtatgccgtcttctg

SEQ ID NO: 775 - DNA, 27 bp, Artificial Sequence
  ARev_31_TGCAAG_G-ov
gcttgcaatctcgtatgccgtcttctg

SEQ ID NO: 776 - DNA, 27 bp, Artificial Sequence
  ARev_32_TCAGAG_G-ov
gctctgaatctcgtatgccgtcttctg

SEQ ID NO: 777 - DNA, 27 bp, Artificial Sequence
  ARev_33_GTTGAG_G-ov
gctcaacatctcgtatgccgtcttctg

SEQ ID NO: 778 - DNA, 27 bp, Artificial Sequence
  ARev_34_TAGCAG_G-ov
gctgctaatctcgtatgccgtcttctg

SEQ ID NO: 779 - DNA, 27 bp, Artificial Sequence
  ARev_35_ATCCAG_G-ov
gctggatatctcgtatgccgtcttctg

SEQ ID NO: 780 - DNA, 27 bp, Artificial Sequence
  ARev_36_TCTTAG_G-ov
gctaaggatctcgtatgccgtcttctg

SEQ ID NO: 781 - DNA, 27 bp, Artificial Sequence
  ARev_37_TTGAGG_G-ov
gcctcaaatctcgtatgccgtcttctg

SEQ ID NO: 782 - DNA, 27 bp, Artificial Sequence
  ARev_38_AACAGG_G-ov
gcctgttatctcgtatgccgtcttctg

SEQ ID NO: 783 - DNA, 27 bp, Artificial Sequence
  ARev_39_GAATGG_G-ov
gccattcatctcgtatgccgtcttctg

SEQ ID NO: 784 - DNA, 27 bp, Artificial Sequence
  ARev_40_AGAACG_G-ov
gcgttctatctcgtatgccgtcttctg

SEQ ID NO: 785 - DNA, 27 bp, Artificial Sequence
  ARev_41_TCTACG_G-ov
gcgtagaatctcgtatgccgtcttctg

SEQ ID NO: 786 - DNA, 27 bp, Artificial Sequence
  ARev_42_TTACCG_G-ov
gcggtaaatctcgtatgccgtcttctg

SEQ ID NO: 787 - DNA, 27 bp, Artificial Sequence
  ARev_43_AAGTCG_G-ov
gcgacttatctcgtatgccgtcttctg

SEQ ID NO: 788 - DNA, 27 bp, Artificial Sequence
  ARev_44_TGTATG_G-ov
gcatacgatctcgtatgccgtcttctg

SEQ ID NO: 789 - DNA, 27 bp, Artificial Sequence
  ARev_45_TAAGTG_G-ov
gcacttgatctcgtatgccgtcttctg

SEQ ID NO: 790 - DNA, 27 bp, Artificial Sequence
  ARev_46_TTCGTG_G-ov
gcacgaaatctcgtatgccgtcttctg

SEQ ID NO: 791 - DNA, 27 bp, Artificial Sequence
  ARev_47_ACTGTG_G-ov
gcacagtatctcgtatgccgtcttctg

SEQ ID NO: 792 - DNA, 27 bp, Artificial Sequence
  ARev_48_GATCTG_G-ov
gcagatcatctcgtatgccgtcttctg

SEQ ID NO: 793 - DNA, 27 bp, Artificial Sequence
  ARev_49_TCGTTG_G-ov
gcaacgaatctcgtatgccgtcttctg

SEQ ID NO: 794 - DNA, 27 bp, Artificial Sequence
  ARev_50_AGCTTG_G-ov
gcaagctatctcgtatgccgtcttctg

SEQ ID NO: 795 - DNA, 27 bp, Artificial Sequence
  ARev_51_GTGAAC_G-ov
ggttcacatctcgtatgccgtcttctg

SEQ ID NO: 796 - DNA, 27 bp, Artificial Sequence
  ARev_52_TACGAC_G-ov
ggtcgtaatctcgtatgccgtcttctg

SEQ ID NO: 797 - DNA, 27 bp, Artificial Sequence
  ARev_53_TGACAC_G-ov
ggtgtcaatctcgtatgccgtcttctg

SEQ ID NO: 798 - DNA, 27 bp, Artificial Sequence
  ARev_54_TTTCAC_G-ov
ggtgaagatctcgtatgccgtcttctg

SEQ ID NO: 799 - DNA, 27 bp, Artificial Sequence
  ARev_55_GGTTAC_G-ov
ggtaaccatctcgtatgccgtcttctg

SEQ ID NO: 800 - DNA, 27 bp, Artificial Sequence
  ARev_56_ACAAGC_G-ov
ggcttgtatctcgtatgccgtcttctg

SEQ ID NO: 801 - DNA, 27 bp, Artificial Sequence
  ARev_57_TTAGGC_G-ov
ggcctaaatctcgtatgccgtcttctg

SEQ ID NO: 802 - DNA, 27 bp, Artificial Sequence
  ARev_58_TAGTGC_G-ov
ggcactaatctcgtatgccgtcttctg

SEQ ID NO: 803 - DNA, 27 bp, Artificial Sequence
  ARev_59_ATCTGC_G-ov
ggcagatatctcgtatgccgtcttctg

SEQ ID NO: 804 - DNA, 27 bp, Artificial Sequence
  ARev_60_TTCACC_G-ov
gggtgaaatctcgtatgccgtcttctg

SEQ ID NO: 805 - DNA, 27 bp, Artificial Sequence
  ARev_61_ATTGCC_G-ov
gggcaatatctcgtatgccgtcttctg

SEQ ID NO: 806 - DNA, 27 bp, Artificial Sequence
  ARev_62_TCATCC_G-ov
gggatgaatctcgtatgccgtcttctg

SEQ ID NO: 807 - DNA, 27 bp, Artificial Sequence
  ARev_63_TATTCC_G-ov
gggaatgatctcgtatgccgtcttctg

SEQ ID NO: 808 - DNA, 27 bp, Artificial Sequence
  ARev_64_AGGATC_G-ov
ggatcctatctcgtatgccgtcttctg

SEQ ID NO: 809 - DNA, 27 bp, Artificial Sequence
  ARev_65_GCTATC_G-ov
ggatagcatctcgtatgccgtcttctg

SEQ ID NO: 810 - DNA, 27 bp, Artificial Sequence
  ARev_66_TGTGTC_G-ov
ggacacaatctcgtatgccgtcttctg

SEQ ID NO: 811 - DNA, 27 bp, Artificial Sequence
  ARev_67_TTGCTC_G-ov
ggagcaaatctcgtatgccgtcttctg

SEQ ID NO: 812 - DNA, 27 bp, Artificial Sequence
  ARev_68_AACCTC_G-ov
ggaggttatctcgtatgccgtcttctg

SEQ ID NO: 813 - DNA, 27 bp, Artificial Sequence
  ARev_69_TGGAAT_G-ov
gattccgatctcgtatgccgtcttctg

SEQ ID NO: 814 - DNA, 27 bp, Artificial Sequence
  ARev_70_GCCAAT_G-ov
gattggcatctcgtatgccgtcttctg

SEQ ID NO: 815 - DNA, 27 bp, Artificial Sequence
  ARev_71_TTCGAT_G-ov
gatcgagatctcgtatgccgtcttctg

SEQ ID NO: 816 - DNA, 27 bp, Artificial Sequence
  ARev_72_GGTAGT_G-ov
gactaccatctcgtatgccgtcttctg

SEQ ID NO: 817 - DNA, 27 bp, Artificial Sequence
  ARev_73_TCTGGT_G-ov
gaccagaatctcgtatgccgtcttctg

SEQ ID NO: 818 - DNA, 27 bp, Artificial Sequence
  ARev_74_AGACGT_G-ov
gacgtctatctcgtatgccgtcttctg

SEQ ID NO: 819 - DNA, 27 bp, Artificial Sequence
  ARev_75_ACGTGT_G-ov
gacacgtatctcgtatgccgtcttctg

SEQ ID NO: 820 - DNA, 27 bp, Artificial Sequence
  ARev_76_TACTGT_G-ov
gacagtgatctcgtatgccgtcttctg

SEQ ID NO: 821 - DNA, 27 bp, Artificial Sequence
  ARev_77_ACAGCT_G-ov
gagctgtatctcgtatgccgtcttctg

SEQ ID NO: 822 - DNA, 27 bp, Artificial Sequence
  ARev_78_TAGGCT_G-ov
gagcctaatctcgtatgccgtcttctg

SEQ ID NO: 823 - DNA, 27 bp, Artificial Sequence
  ARev_79_GAACCT_G-ov
gaggttcatctcgtatgccgtcttctg

SEQ ID NO: 824 - DNA, 27 bp, Artificial Sequence
  ARev_80_ATGCCT_G-ov
gaggcatatctcgtatgccgtcttctg

SEQ ID NO: 825 - DNA, 27 bp, Artificial Sequence
  ARev_81_TGTCCT_G-ov
gaggacaatctcgtatgccgtcttctg

SEQ ID NO: 826 - DNA, 27 bp, Artificial Sequence
  ARev_82_GCTTCT_G-ov
gagaagcatctcgtatgccgtcttctg

SEQ ID NO: 827 - DNA, 27 bp, Artificial Sequence
  ARev_83_GACGTT_G-ov
gaacgtcatctcgtatgccgtcttctg

SEQ ID NO: 828 - DNA, 27 bp, Artificial Sequence
  ARev_84_TAGCTT_G-ov
gaagctgatctcgtatgccgtcttctg

SEQ ID NO: 829 - DNA, 27 bp, Artificial Sequence
  ARev_85_TACTCG_G-ov
gcgagtaatctcgtatgccgtcttctg

SEQ ID NO: 830 - DNA, 27 bp, Artificial Sequence
  ARev_86_GGATTC_G-ov
ggaatccatctcgtatgccgtcttctg

SEQ ID NO: 831 - DNA, 27 bp, Artificial Sequence
  ARev_87_TCATTC_G-ov
ggaatggatctcgtatgccgtcttctg

SEQ ID NO: 832 - DNA, 27 bp, Artificial Sequence
  ARev_88_GCACTT_G-ov
gaagtgcatctcgtatgccgtcttctg

SEQ ID NO: 833 - DNA, 27 bp, Artificial Sequence
  ARev_89_TCTCTT_G-ov
gaagaggatctcgtatgccgtcttctg

SEQ ID NO: 834 - DNA, 27 bp, Artificial Sequence
  ARev_90_TCTGTA_G-ov
gtacaggatctcgtatgccgtcttctg

SEQ ID NO: 835 - DNA, 27 bp, Artificial Sequence
  ARev_91_AGTCAG_G-ov
gctgactatctcgtatgccgtcttctg

SEQ ID NO: 836 - DNA, 27 bp, Artificial Sequence
  ARev_92_GACTAG_G-ov
gctagtcatctcgtatgccgtcttctg

SEQ ID NO: 837 - DNA, 27 bp, Artificial Sequence
  ARev_93_TTTAGG_G-ov
gcctaagatctcgtatgccgtcttctg

SEQ ID NO: 838 - DNA, 27 bp, Artificial Sequence
  ARev_94_TTATGG_G-ov
gccatagatctcgtatgccgtcttctg

SEQ ID NO: 839 - DNA, 27 bp, Artificial Sequence
  ARev_95_GTTACG_G-ov
gcgtaacatctcgtatgccgtcttctg

SEQ ID NO: 840 - DNA, 27 bp, Artificial Sequence
  ARev_96_GCATTG_G-ov
gcaatgcatctcgtatgccgtcttctg

SEQ ID NO: 841 - DNA, 26 bp, Artificial Sequence
  BRev_1_TCCGTT-T_ov
taacggagtgtagatctcggtggtcg

SEQ ID NO: 842 - DNA, 26 bp, Artificial Sequence
  BRev_2_GTTGGT-T_ov
taccaacgtgtagatctcggtggtcg

SEQ ID NO: 843 - DNA, 26 bp, Artificial Sequence
  BRev_3_GATCTC-T_ov
tgagatcgtgtagatctcggtggtcg

SEQ ID NO: 844 - DNA, 26 bp, Artificial Sequence
  BRev_4_GAGAAG-T_ov
tcttctcgtgtagatctcggtggtcg

SEQ ID NO: 845 - DNA, 26 bp, Artificial Sequence
  BRev_5_AGGAAC-T_ov
tgttcctgtgtagatctcggtggtcg

SEQ ID NO: 846 - DNA, 26 bp, Artificial Sequence
  BRev_6_CCGAAA-T_ov
ttttcgggtgtagatctcggtggtcg

SEQ ID NO: 847 - DNA, 26 bp, Artificial Sequence
  BRev_7_CACAAC-T_ov
tgttgtggtgtagatctcggtggtcg

SEQ ID NO: 848 - DNA, 26 bp, Artificial Sequence
  BRev_8_GGCAAA-T_ov
ttttgccgtgtagatctcggtggtcg

SEQ ID NO: 849 - DNA, 26 bp, Artificial Sequence
  BRev_9_ACCAAG-T_ov
tcttggtgtgtagatctcggtggtcg

SEQ ID NO: 850 - DNA, 26 bp, Artificial Sequence
  BRev_10_CGTAAG-T_ov
tcttacggtgtagatctcggtggtcg

SEQ ID NO: 851 - DNA, 26 bp, Artificial Sequence
  BRev_11_GCTAAC-T_ov
tgttagcgtgtagatctcggtggtcg

SEQ ID NO: 852 - DNA, 26 bp, Artificial Sequence
  BRev_12_GAAGAC-T_ov
tgtcttcgtgtagatctcggtggtcg

SEQ ID NO: 853 - DNA, 26 bp, Artificial Sequence
  BRev_13_AGAGAG-T_ov
tctctctgtgtagatctcggtggtcg

SEQ ID NO: 854 - DNA, 26 bp, Artificial Sequence
  BRev_14_CCAGAT-T_ov
tatctgggtgtagatctcggtggtcg

SEQ ID NO: 855 - DNA, 26 bp, Artificial Sequence
  BRev_15_GTGGAA-T_ov
tttccacgtgtagatctcggtggtcg

SEQ ID NO: 856 - DNA, 26 bp, Artificial Sequence
  BRev_16_TACGAG-T_ov
tctcgtagtgtagatctcggtggtcg

SEQ ID NO: 857 - DNA, 26 bp, Artificial Sequence
  BRev_17_ATCGAC-T_ov
tgtcgatgtgtagatctcggtggtcg

SEQ ID NO: 858 - DNA, 26 bp, Artificial Sequence
  BRev_18_TGTGAC-T_ov
tgtcacagtgtagatctcggtggtcg

SEQ ID NO: 859 - DNA, 26 bp, Artificial Sequence
  BRev_19_CAACAG-T_ov
tctgttggtgtagatctcggtggtcg

SEQ ID NO: 860 - DNA, 26 bp, Artificial Sequence
  BRev_20_GGACAT-T_ov
tatgtccgtgtagatctcggtggtcg

SEQ ID NO: 861 - DNA, 26 bp, Artificial Sequence
  BRev_21_ACACAC-T_ov
tgtgtgtgtgtagatctcggtggtcg

SEQ ID NO: 862 - DNA, 26 bp, Artificial Sequence
  BRev_22_TAGCAC-T_ov
tgtgctagtgtagatctcggtggtcg

SEQ ID NO: 863 - DNA, 26 bp, Artificial Sequence
  BRev_23_ATGCAG-T_ov
tctgcatgtgtagatctcggtggtcg

SEQ ID NO: 864 - DNA, 26 bp, Artificial Sequence
  BRev_24_CTCCAA-T_ov
tttggaggtgtagatctcggtggtcg

SEQ ID NO: 865 - DNA, 26 bp, Artificial Sequence
  BRev_25_TCTCAG-T_ov
tctgagagtgtagatctcggtggtcg

SEQ ID NO: 866 - DNA, 26 bp, Artificial Sequence
  BRev_26_CGATAC-T_ov
tgtatcggtgtagatctcggtggtcg

SEQ ID NO: 867 - DNA, 26 bp, Artificial Sequence
  BRev_27_GCATAG-T_ov
tctatgcgtgtagatctcggtggtcg

SEQ ID NO: 868 - DNA, 26 bp, Artificial Sequence
  BRev_28_TGGTAG-T_ov
tctaccagtgtagatctcggtggtcg

SEQ ID NO: 869 - DNA, 26 bp, Artificial Sequence
  BRev_29_TCCTAC-T_ov
tgtaggagtgtagatctcggtggtcg

SEQ ID NO: 870 - DNA, 26 bp, Artificial Sequence
  BRev_30_CGAAGA-T_ov
ttcttcggtgtagatctcggtggtcg

SEQ ID NO: 871 - DNA, 26 bp, Artificial Sequence
  BRev_31_GCAAGT-T_ov
tacttgcgtgtagatctcggtggtcg

SEQ ID NO: 872 - DNA, 26 bp, Artificial Sequence
  BRev_32_CAGAGT-T_ov
tactctggtgtagatctcggtggtcg

SEQ ID NO: 873 - DNA, 26 bp, Artificial Sequence
  BRev_33_TTGAGG-T_ov
tcctcaagtgtagatctcggtggtcg

SEQ ID NO: 874 - DNA, 26 bp, Artificial Sequence
  BRev_34_AGCAGT-T_ov
tactgctgtgtagatctcggtggtcg

SEQ ID NO: 875 - DNA, 26 bp, Artificial Sequence
  BRev_35_TCCAGA-T_ov
ttctggagtgtagatctcggtggtcg

SEQ ID NO: 876 - DNA, 26 bp, Artificial Sequence
  BRev_36_CTTAGC-T_ov
tgctaaggtgtagatctcggtggtcg

SEQ ID NO: 877 - DNA, 26 bp, Artificial Sequence
  BRev_37_TGAGGT-T_ov
tacctcagtgtagatctcggtggtcg

SEQ ID NO: 878 - DNA, 26 bp, Artificial Sequence
  BRev_38_ACAGGA-T_ov
ttcctgtgtgtagatctcggtggtcg

SEQ ID NO: 879 - DNA, 26 bp, Artificial Sequence
  BRev_39_AATGGG-T_ov
tcccattgtgtagatctcggtggtcg

SEQ ID NO: 880 - DNA, 26 bp, Artificial Sequence
  BRev_40_GAACGA-T_ov
ttcgttcgtgtagatctcggtggtcg

SEQ ID NO: 881 - DNA, 26 bp, Artificial Sequence
  BRev_41_CTACGT-T_ov
tacgtaggtgtagatctcggtggtcg

SEQ ID NO: 882 - DNA, 26 bp, Artificial Sequence
  BRev_42_TACCGT-T_ov
tacggtagtgtagatctcggtggtcg

SEQ ID NO: 883 - DNA, 26 bp, Artificial Sequence
  BRev_43_AGTCGA-T_ov
ttcgactgtgtagatctcggtggtcg

SEQ ID NO: 884 - DNA, 26 bp, Artificial Sequence
  BRev_44_GTATGC-T_ov
tgcatacgtgtagatctcggtggtcg

SEQ ID NO: 885 - DNA, 26 bp, Artificial Sequence
  BRev_45_AAGTGC-T_ov
tgcacttgtgtagatctcggtggtcg

SEQ ID NO: 886 - DNA, 26 bp, Artificial Sequence
  BRev_46_TCGTGT-T_ov
tacacgagtgtagatctcggtggtcg

SEQ ID NO: 887 - DNA, 26 bp, Artificial Sequence
  BRev_47_CTGTGA-T_ov
ttcacaggtgtagatctcggtggtcg

SEQ ID NO: 888 - DNA, 26 bp, Artificial Sequence
  BRev_48_ATCTGG-T_ov
tccagatgtgtagatctcggtggtcg

SEQ ID NO: 889 - DNA, 26 bp, Artificial Sequence
  BRev_49_CGTTGT-T_ov
tacaacggtgtagatctcggtggtcg

SEQ ID NO: 890 - DNA, 26 bp, Artificial Sequence
  BRev_50_GCTTGA-T_ov
ttcaagcgtgtagatctcggtggtcg

SEQ ID NO: 891 - DNA, 26 bp, Artificial Sequence
  BRev_51_TGAACG-T_ov
tcgttcagtgtagatctcggtggtcg

SEQ ID NO: 892 - DNA, 26 bp, Artificial Sequence
  BRev_52_ACGACT-T_ov
tagtcgtgtgtagatctcggtggtcg

SEQ ID NO: 893 - DNA, 26 bp, Artificial Sequence
  BRev_53_GACACT-T_ov
tagtgtcgtgtagatctcggtggtcg

SEQ ID NO: 894 - DNA, 26 bp, Artificial Sequence
  BRev_54_TTCACC-T_ov
tggtgaagtgtagatctcggtggtcg

SEQ ID NO: 895 - DNA, 26 bp, Artificial Sequence
  BRev_55_GTTACG-T_ov
tcgtaacgtgtagatctcggtggtcg

SEQ ID NO: 896 - DNA, 26 bp, Artificial Sequence
  BRev_56_CAAGCA-T_ov
ttgcttggtgtagatctcggtggtcg

SEQ ID NO: 897 - DNA, 26 bp, Artificial Sequence
  BRev_57_TAGGCT-T_ov
tagcctagtgtagatctcggtggtcg

SEQ ID NO: 898 - DNA, 26 bp, Artificial Sequence
  BRev_58_AGTGCT-T_ov
tagcactgtgtagatctcggtggtcg

SEQ ID NO: 899 - DNA, 26 bp, Artificial Sequence
  BRev_59_TCTGCA-T_ov
ttgcagagtgtagatctcggtggtcg

SEQ ID NO: 900 - DNA, 26 bp, Artificial Sequence
  BRev_60_TCACCT-T_ov
taggtgagtgtagatctcggtggtcg

SEQ ID NO: 901 - DNA, 26 bp, Artificial Sequence
  BRev_61_TTGCCA-T_ov
ttggcaagtgtagatctcggtggtcg

SEQ ID NO: 902 - DNA, 26 bp, Artificial Sequence
  BRev_62_CATCCT-T_ov
taggatggtgtagatctcggtggtcg

SEQ ID NO: 903 - DNA, 26 bp, Artificial Sequence
  BRev_63_ATTCCC-T_ov
tgggaatgtgtagatctcggtggtcg

SEQ ID NO: 904 - DNA, 26 bp, Artificial Sequence
  BRev_64_GGATCA-T_ov
ttgatccgtgtagatctcggtggtcg

SEQ ID NO: 905 - DNA, 26 bp, Artificial Sequence
  BRev_65_CTATCG-T_ov
tcgataggtgtagatctcggtggtcg

SEQ ID NO: 906 - DNA, 26 bp, Artificial Sequence
  BRev_66_GTGTCT-T_ov
tagacacgtgtagatctcggtggtcg

SEQ ID NO: 907 - DNA, 26 bp, Artificial Sequence
  BRev_67_TGCTCT-T_ov
tagagcagtgtagatctcggtggtcg

SEQ ID NO: 908 - DNA, 26 bp, Artificial Sequence
  BRev_68_ACCTCA-T_ov
ttgaggtgtgtagatctcggtggtcg

SEQ ID NO: 909 - DNA, 26 bp, Artificial Sequence
  BRev_69_GGAATC-T_ov
tgattccgtgtagatctcggtggtcg

SEQ ID NO: 910 - DNA, 26 bp, Artificial Sequence
  BRev_70_CCAATG-T_ov
tcattgggtgtagatctcggtggtcg

SEQ ID NO: 911 - DNA, 26 bp, Artificial Sequence
  BRev_71_TCGATC-T_ov
tgatcgagtgtagatctcggtggtcg

SEQ ID NO: 912 - DNA, 26 bp, Artificial Sequence
  BRev_72_GTAGTG-T_ov
tcactacgtgtagatctcggtggtcg

SEQ ID NO: 913 - DNA, 26 bp, Artificial Sequence
  BRev_73_CTGGTT-T_ov
taaccaggtgtagatctcggtggtcg

SEQ ID NO: 914 - DNA, 26 bp, Artificial Sequence
  BRev_74_GACGTA-T_ov
ttacgtcgtgtagatctcggtggtcg

SEQ ID NO: 915 - DNA, 26 bp, Artificial Sequence
  BRev_75_CGTGTA-T_ov
ttacacggtgtagatctcggtggtcg

SEQ ID NO: 916 - DNA, 26 bp, Artificial Sequence
  BRev_76_ACTGTC-T_ov
tgacagtgtgtagatctcggtggtcg

SEQ ID NO: 917 - DNA, 26 bp, Artificial Sequence
  BRev_77_CAGCTA-T_ov
ttagctggtgtagatctcggtggtcg

SEQ ID NO: 918 - DNA, 26 bp, Artificial Sequence
  BRev_78_AGGCTT-T_ov
taagcctgtgtagatctcggtggtcg

SEQ ID NO: 919 - DNA, 26 bp, Artificial Sequence
  BRev_79_AACCTG-T_ov
tcaggttgtgtagatctcggtggtcg

SEQ ID NO: 920 - DNA, 26 bp, Artificial Sequence
  BRev_80_TGCCTA-T_ov
ttaggcagtgtagatctcggtggtcg

SEQ ID NO: 921 - DNA, 26 bp, Artificial Sequence
  BRev_81_GTCCTT-T_ov
taaggacgtgtagatctcggtggtcg

SEQ ID NO: 922 - DNA, 26 bp, Artificial Sequence
  BRev_82_CTTCTG-T_ov
tcagaaggtgtagatctcggtggtcg

SEQ ID NO: 923 - DNA, 26 bp, Artificial Sequence
  BRev_83_ACGTTG-T_ov
tcaacgtgtgtagatctcggtggtcg

SEQ ID NO: 924 - DNA, 26 bp, Artificial Sequence
  BRev_84_AGCTTC-T_ov
tgaagctgtgtagatctcggtggtcg

SEQ ID NO: 925 - DNA, 26 bp, Artificial Sequence
  BRev_85_ACTCGT-T_ov
tacgagtgtgtagatctcggtggtcg

SEQ ID NO: 926 - DNA, 26 bp, Artificial Sequence
  BRev_86_GATTCG-T_ov
tcgaatcgtgtagatctcggtggtcg

SEQ ID NO: 927 - DNA, 26 bp, Artificial Sequence
  BRev_87_CATTCC-T_ov
tggaatggtgtagatctcggtggtcg

SEQ ID NO: 928 - DNA, 26 bp, Artificial Sequence
  BRev_88_CACTTG-T_ov
tcaagtggtgtagatctcggtggtcg

SEQ ID NO: 929 - DNA, 26 bp, Artificial Sequence
  BRev_89_CTCTTC-T_ov
tgaagaggtgtagatctcggtggtcg

SEQ ID NO: 930 - DNA, 26 bp, Artificial Sequence
  BRev_90_CTGTAC-T_ov
tgtacaggtgtagatctcggtggtcg

SEQ ID NO: 931 - DNA, 26 bp, Artificial Sequence
  BRev_91_GTCAGA-T_ov
ttctgacgtgtagatctcggtggtcg

SEQ ID NO: 932 - DNA, 26 bp, Artificial Sequence
  BRev_92_ACTAGG-T_ov
tcctagtgtgtagatctcggtggtcg

SEQ ID NO: 933 - DNA, 26 bp, Artificial Sequence
  BRev_93_TTAGGC-T_ov
tgcctaagtgtagatctcggtggtcg

SEQ ID NO: 934 - DNA, 26 bp, Artificial Sequence
  BRev_94_TATGGC-T_ov
tgccatagtgtagatctcggtggtcg

SEQ ID NO: 935 - DNA, 26 bp, Artificial Sequence
  BRev_95_TTACGG-T_ov
tccgtaagtgtagatctcggtggtcg

SEQ ID NO: 936 - DNA, 26 bp, Artificial Sequence
  BRev_96_CATTGG-T_ov
tccaatggtgtagatctcggtggtcg

SEQ ID NO: 937 - DNA, 26 bp, Artificial Sequence
  BRev_1_TCCGTT-G_ov
gaacggagtgtagatctcggtggtcg

SEQ ID NO: 938 - DNA, 26 bp, Artificial Sequence
  BRev_2_GTTGGT-G_ov
gaccaacgtgtagatctcggtggtcg

SEQ ID NO: 939 - DNA, 26 bp, Artificial Sequence
  BRev_3_GATCTC-G_ov
ggagatcgtgtagatctcggtggtcg

SEQ ID NO: 940 - DNA, 26 bp, Artificial Sequence
  BRev_4_GAGAAG-G_ov
gcttctcgtgtagatctcggtggtcg

SEQ ID NO: 941 - DNA, 26 bp, Artificial Sequence
  BRev_5_AGGAAC-G_ov
ggttcctgtgtagatctcggtggtcg

SEQ ID NO: 942 - DNA, 26 bp, Artificial Sequence
  BRev_6_CCGAAA-G_ov
gtttcgggtgtagatctcggtggtcg

SEQ ID NO: 943 - DNA, 26 bp, Artificial Sequence
  BRev_7_CACAAC-G_ov
ggttgtggtgtagatctcggtggtcg

SEQ ID NO: 944 - DNA, 26 bp, Artificial Sequence
  BRev_8_GGCAAA-G_ov
gtttgccgtgtagatctcggtggtcg

SEQ ID NO: 945 - DNA, 26 bp, Artificial Sequence
  BRev_9_ACCAAG-G_ov
gcttggtgtgtagatctcggtggtcg

SEQ ID NO: 946 - DNA, 26 bp, Artificial Sequence
  BRev_10_CGTAAG-G_ov
gcttacggtgtagatctcggtggtcg

SEQ ID NO: 947 - DNA, 26 bp, Artificial Sequence
  BRev_11_GCTAAC-G_ov
ggttagcgtgtagatctcggtggtcg

SEQ ID NO: 948 - DNA, 26 bp, Artificial Sequence
  BRev_12_GAAGAC-G_ov
ggtcttcgtgtagatctcggtggtcg

SEQ ID NO: 949 - DNA, 26 bp, Artificial Sequence
  BRev_13_AGAGAG-G_ov
gctctctgtgtagatctcggtggtcg

SEQ ID NO: 950 - DNA, 26 bp, Artificial Sequence
  BRev_14_CCAGAT-G_ov
gatctgggtgtagatctcggtggtcg

SEQ ID NO: 951 - DNA, 26 bp, Artificial Sequence
  BRev_15_GTGGAA-G_ov
gttccacgtgtagatctcggtggtcg

SEQ ID NO: 952 - DNA, 26 bp, Artificial Sequence
  BRev_16_TACGAG-G_ov
gctcgtagtgtagatctcggtggtcg

SEQ ID NO: 953 - DNA, 26 bp, Artificial Sequence
  BRev_17_ATCGAC-G_ov
ggtcgatgtgtagatctcggtggtcg

SEQ ID NO: 954 - DNA, 26 bp, Artificial Sequence
  BRev_18_TGTGAC-G_ov
ggtcacagtgtagatctcggtggtcg

SEQ ID NO: 955 - DNA, 26 bp, Artificial Sequence
  BRev_19_CAACAG-G_ov
gctgttggtgtagatctcggtggtcg

SEQ ID NO: 956 - DNA, 26 bp, Artificial Sequence
  BRev_20_GGACAT-G_ov
gatgtccgtgtagatctcggtggtcg

SEQ ID NO: 957 - DNA, 26 bp, Artificial Sequence
  BRev_21_ACACAC-G_ov
ggtgtgtgtgtagatctcggtggtcg

SEQ ID NO: 958 - DNA, 26 bp, Artificial Sequence
  BRev_22_TAGCAC-G_ov
ggtgctagtgtagatctcggtggtcg

SEQ ID NO: 959 - DNA, 26 bp, Artificial Sequence
  BRev_23_ATGCAG-G_ov
gctgcatgtgtagatctcggtggtcg

SEQ ID NO: 960 - DNA, 26 bp, Artificial Sequence
  BRev_24_CTCCAA-G_ov
gttggaggtgtagatctcggtggtcg

SEQ ID NO: 961 - DNA, 26 bp, Artificial Sequence
  BRev_25_TCTCAG-G_ov
gctgagagtgtagatctcggtggtcg

SEQ ID NO: 962 - DNA, 26 bp, Artificial Sequence
  BRev_26_CGATAC-G_ov
ggtatcggtgtagatctcggtggtcg

SEQ ID NO: 963 - DNA, 26 bp, Artificial Sequence
  BRev_27_GCATAG-G_ov
gctatgcgtgtagatctcggtggtcg

SEQ ID NO: 964 - DNA, 26 bp, Artificial Sequence
  BRev_28_TGGTAG-G_ov
gctaccagtgtagatctcggtggtcg

SEQ ID NO: 965 - DNA, 26 bp, Artificial Sequence
  BRev_29_TCCTAC-G_ov
ggtaggagtgtagatctcggtggtcg

SEQ ID NO: 966 - DNA, 26 bp, Artificial Sequence
  BRev_30_CGAAGA-G_ov
gtcttcggtgtagatctcggtggtcg

SEQ ID NO: 967 - DNA, 26 bp, Artificial Sequence
  BRev_31_GCAAGT-G_ov
gacttgcgtgtagatctcggtggtcg

SEQ ID NO: 968 - DNA, 26 bp, Artificial Sequence
  BRev_32_CAGAGT-G_ov
gactctggtgtagatctcggtggtcg

SEQ ID NO: 969 - DNA, 26 bp, Artificial Sequence
  BRev_33_TTGAGG-G_ov
gcctcaagtgtagatctcggtggtcg

SEQ ID NO: 970 - DNA, 26 bp, Artificial Sequence
  BRev_34_AGCAGT-G_ov
gactgctgtgtagatctcggtggtcg

SEQ ID NO: 971 - DNA, 26 bp, Artificial Sequence
  BRev_35_TCCAGA-G_ov
gtctggagtgtagatctcggtggtcg

SEQ ID NO: 972 - DNA, 26 bp, Artificial Sequence
  BRev_36_CTTAGC-G_ov
ggctaaggtgtagatctcggtggtcg

SEQ ID NO: 973 - DNA, 26 bp, Artificial Sequence
  BRev_37_TGAGGT-G_ov
gacctcagtgtagatctcggtggtcg

SEQ ID NO: 974 - DNA, 26 bp, Artificial Sequence
  BRev_38_ACAGGA-G_ov
gtcctgtgtgtagatctcggtggtcg

SEQ ID NO: 975 - DNA, 26 bp, Artificial Sequence
  BRev_39_AATGGG-G_ov
gcccattgtgtagatctcggtggtcg

SEQ ID NO: 976 - DNA, 26 bp, Artificial Sequence
  BRev_40_GAACGA-G_ov
gtcgttcgtgtagatctcggtggtcg

SEQ ID NO: 977 - DNA, 26 bp, Artificial Sequence
  BRev_41_CTACGT-G_ov
gacgtaggtgtagatctcggtggtcg

SEQ ID NO: 978 - DNA, 26 bp, Artificial Sequence
  BRev_42_TACCGT-G_ov
gacggtagtgtagatctcggtggtcg

SEQ ID NO: 979 - DNA, 26 bp, Artificial Sequence
  BRev_43_AGTCGA-G_ov
gtcgactgtgtagatctcggtggtcg

SEQ ID NO: 980 - DNA, 26 bp, Artificial Sequence
  BRev_44_GTATGC-G_ov
ggcatacgtgtagatctcggtggtcg

SEQ ID NO: 981 - DNA, 26 bp, Artificial Sequence
  BRev_45_AAGTGC-G_ov
ggcacttgtgtagatctcggtggtcg

SEQ ID NO: 982 - DNA, 26 bp, Artificial Sequence
  BRev_46_TCGTGT-G_ov
gacacgagtgtagatctcggtggtcg

SEQ ID NO: 983 - DNA, 26 bp, Artificial Sequence
  BRev_47_CTGTGA-G_ov
gtcacaggtgtagatctcggtggtcg

SEQ ID NO: 984 - DNA, 26 bp, Artificial Sequence
  BRev_48_ATCTGG-G_ov
gccagatgtgtagatctcggtggtcg

SEQ ID NO: 985 - DNA, 26 bp, Artificial Sequence
  BRev_49_CGTTGT-G_ov
gacaacggtgtagatctcggtggtcg

SEQ ID NO: 986 - DNA, 26 bp, Artificial Sequence
  BRev_50_GCTTGA-G_ov
gtcaagcgtgtagatctcggtggtcg

SEQ ID NO: 987 - DNA, 26 bp, Artificial Sequence
  BRev_51_TGAACG-G_ov
gcgttcagtgtagatctcggtggtcg

SEQ ID NO: 988 - DNA, 26 bp, Artificial Sequence
  BRev_52_ACGACT-G_ov
gagtcgtgtgtagatctcggtggtcg

SEQ ID NO: 989 - DNA, 26 bp, Artificial Sequence
  BRev_53_GACACT-G_ov
gagtgtcgtgtagatctcggtggtcg

SEQ ID NO: 990 - DNA, 26 bp, Artificial Sequence
  BRev_54_TTCACC-G_ov
gggtgaagtgtagatctcggtggtcg

SEQ ID NO: 991 - DNA, 26 bp, Artificial Sequence
  BRev_55_GTTACG-G_ov
gcgtaacgtgtagatctcggtggtcg

SEQ ID NO: 992 - DNA, 26 bp, Artificial Sequence
  BRev_56_CAAGCA-G_ov
gtgcttggtgtagatctcggtggtcg

SEQ ID NO: 993 - DNA, 26 bp, Artificial Sequence
  BRev_57_TAGGCT-G_ov
gagcctagtgtagatctcggtggtcg

SEQ ID NO: 994 - DNA, 26 bp, Artificial Sequence
  BRev_58_AGTGCT-G_ov
gagcactgtgtagatctcggtggtcg

SEQ ID NO: 995 - DNA, 26 bp, Artificial Sequence
  BRev_59_TCTGCA-G_ov
gtgcagagtgtagatctcggtggtcg

SEQ ID NO: 996 - DNA, 26 bp, Artificial Sequence
  BRev_60_TCACCT-G_ov
gaggtgagtgtagatctcggtggtcg

SEQ ID NO: 997 - DNA, 26 bp, Artificial Sequence
  BRev_61_TTGCCA-G_ov
gtggcaagtgtagatctcggtggtcg

SEQ ID NO: 998 - DNA, 26 bp, Artificial Sequence
  BRev_62_CATCCT-G_ov
gaggatggtgtagatctcggtggtcg

SEQ ID NO: 999 - DNA, 26 bp, Artificial Sequence
  BRev_63_ATTCCC-G_ov
ggggaatgtgtagatctcggtggtcg

SEQ ID NO: 1000 - DNA, 26 bp, Artificial Sequence
  BRev_64_GGATCA-G_ov
gtgatccgtgtagatctcggtggtcg

SEQ ID NO: 1001 - DNA, 26 bp, Artificial Sequence
  BRev_65_CTATCG-G_ov
gcgataggtgtagatctcggtggtcg

SEQ ID NO: 1002 - DNA, 26 bp, Artificial Sequence
  BRev_66_GTGTCT-G_ov
gagacacgtgtagatctcggtggtcg

SEQ ID NO: 1003 - DNA, 26 bp, Artificial Sequence
  BRev_67_TGCTCT-G_ov
gagagcagtgtagatctcggtggtcg

SEQ ID NO: 1004 - DNA, 26 bp, Artificial Sequence
  BRev_68_ACCTCA-G_ov
gtgaggtgtgtagatctcggtggtcg

SEQ ID NO: 1005 - DNA, 26 bp, Artificial Sequence
  BRev_69_GGAATC-G_ov
ggattccgtgtagatctcggtggtcg

SEQ ID NO: 1006 - DNA, 26 bp, Artificial Sequence
  BRev_70_CCAATG-G_ov
gcattgggtgtagatctcggtggtcg

SEQ ID NO: 1007 - DNA, 26 bp, Artificial Sequence
  BRev_71_TCGATC-G_ov
ggatcgagtgtagatctcggtggtcg

SEQ ID NO: 1008 - DNA, 26 bp, Artificial Sequence
  BRev_72_GTAGTG-G_ov
gcactacgtgtagatctcggtggtcg

SEQ ID NO: 1009 - DNA, 26 bp, Artificial Sequence
  BRev_73_CTGGTT-G_ov
gaaccaggtgtagatctcggtggtcg

SEQ ID NO: 1010 - DNA, 26 bp, Artificial Sequence
  BRev_74_GACGTA-G_ov
gtacgtcgtgtagatctcggtggtcg

SEQ ID NO: 1011 - DNA, 26 bp, Artificial Sequence
  BRev_75_CGTGTA-G_ov
gtacacggtgtagatctcggtggtcg

SEQ ID NO: 1012 - DNA, 26 bp, Artificial Sequence
  BRev_76_ACTGTC-G_ov
ggacagtgtgtagatctcggtggtcg

SEQ ID NO: 1013 - DNA, 26 bp, Artificial Sequence
  BRev_77_CAGCTA-G_ov
gtagctggtgtagatctcggtggtcg

SEQ ID NO: 1014 - DNA, 26 bp, Artificial Sequence
  BRev_78_AGGCTT-G_ov
gaagcctgtgtagatctcggtggtcg

SEQ ID NO: 1015 - DNA, 26 bp, Artificial Sequence
  BRev_79_AACCTG-G_ov
gcaggttgtgtagatctcggtggtcg

SEQ ID NO: 1016 - DNA, 26 bp, Artificial Sequence
  BRev_80_TGCCTA-G_ov
gtaggcagtgtagatctcggtggtcg

SEQ ID NO: 1017 - DNA, 26 bp, Artificial Sequence
  BRev_81_GTCCTT-G_ov
gaaggacgtgtagatctcggtggtcg

SEQ ID NO: 1018 - DNA, 26 bp, Artificial Sequence
  BRev_82_CTTCTG-G_ov
gcagaaggtgtagatctcggtggtcg

SEQ ID NO: 1019 - DNA, 26 bp, Artificial Sequence
  BRev_83_ACGTTG-G_ov
gcaacgtgtgtagatctcggtggtcg

SEQ ID NO: 1020 - DNA, 26 bp, Artificial Sequence
  BRev_84_AGCTTC-G_ov
ggaagctgtgtagatctcggtggtcg

SEQ ID NO: 1021 - DNA, 26 bp, Artificial Sequence
  BRev_85_ACTCGT-G_ov
gacgagtgtgtagatctcggtggtcg

SEQ ID NO: 1022 - DNA, 26 bp, Artificial Sequence
  BRev_86_GATTCG-G_ov
gcgaatcgtgtagatctcggtggtcg

SEQ ID NO: 1023 - DNA, 26 bp, Artificial Sequence
  BRev_87_CATTCC-G_ov
gggaatggtgtagatctcggtggtcg

SEQ ID NO: 1024 - DNA, 26 bp, Artificial Sequence
  BRev_88_CACTTG-G_ov
gcaagtggtgtagatctcggtggtcg

SEQ ID NO: 1025 - DNA, 26 bp, Artificial Sequence
  BRev_89_CTCTTC-G_ov
ggaagaggtgtagatctcggtggtcg

SEQ ID NO: 1026 - DNA, 26 bp, Artificial Sequence
  BRev_90_CTGTAC-G_ov
ggtacaggtgtagatctcggtggtcg

SEQ ID NO: 1027 - DNA, 26 bp, Artificial Sequence
  BRev_91_GTCAGA-G_ov
gtctgacgtgtagatctcggtggtcg

SEQ ID NO: 1028 - DNA, 26 bp, Artificial Sequence
  BRev_92_ACTAGG-G_ov
gcctagtgtgtagatctcggtggtcg

SEQ ID NO: 1029 - DNA, 26 bp, Artificial Sequence
  BRev_93_TTAGGC-G_ov
ggcctaagtgtagatctcggtggtcg

SEQ ID NO: 1030 - DNA, 26 bp, Artificial Sequence
  BRev_94_TATGGC-G_ov
ggccatagtgtagatctcggtggtcg

SEQ ID NO: 1031 - DNA, 26 bp, Artificial Sequence
  BRev_95_TTACGG-G_ov
gccgtaagtgtagatctcggtggtcg

SEQ ID NO: 1032 - DNA, 26 bp, Artificial Sequence
  BRev_96_CATTGG-G_ov
gccaatggtgtagatctcggtggtcg

SEQ ID NO: 1033 - DNA, 26 bp, Artificial Sequence
  BRev_1_TCCGTT-A_ov
aaacggagtgtagatctcggtggtcg

SEQ ID NO: 1034 - DNA, 26 bp, Artificial Sequence
  BRev_2_GTTGGT-A_ov
aaccaacgtgtagatctcggtggtcg

SEQ ID NO: 1035 - DNA, 26 bp, Artificial Sequence
  BRev_3_GATCTC-A_ov
agagatcgtgtagatctcggtggtcg

SEQ ID NO: 1036 - DNA, 26 bp, Artificial Sequence
  BRev_4_GAGAAG-A_ov
acttctcgtgtagatctcggtggtcg

SEQ ID NO: 1037 - DNA, 26 bp, Artificial Sequence
  BRev_5_AGGAAC-A_ov
agttcctgtgtagatctcggtggtcg

SEQ ID NO: 1038 - DNA, 26 bp, Artificial Sequence
  BRev_6_CCGAAA-A_ov
atttcgggtgtagatctcggtggtcg

SEQ ID NO: 1039 - DNA, 26 bp, Artificial Sequence
  BRev_7_CACAAC-A_ov
agttgtggtgtagatctcggtggtcg

SEQ ID NO: 1040 - DNA, 26 bp, Artificial Sequence
  BRev_8_GGCAAA-A_ov
atttgccgtgtagatctcggtggtcg

SEQ ID NO: 1041 - DNA, 26 bp, Artificial Sequence
  BRev_9_ACCAAG-A_ov
acttggtgtgtagatctcggtggtcg

SEQ ID NO: 1042 - DNA, 26 bp, Artificial Sequence
  BRev_10_CGTAAG-A_ov
acttacggtgtagatctcggtggtcg

SEQ ID NO: 1043 - DNA, 26 bp, Artificial Sequence
  BRev_11_GCTAAC-A_ov
agttagcgtgtagatctcggtggtcg

SEQ ID NO: 1044 - DNA, 26 bp, Artificial Sequence
  BRev_12_GAAGAC-A_ov
agtcttcgtgtagatctcggtggtcg

SEQ ID NO: 1045 - DNA, 26 bp, Artificial Sequence
  BRev_13_AGAGAG-A_ov
actctctgtgtagatctcggtggtcg

SEQ ID NO: 1046 - DNA, 26 bp, Artificial Sequence
  BRev_14_CCAGAT-A_ov
aatctgggtgtagatctcggtggtcg

SEQ ID NO: 1047 - DNA, 26 bp, Artificial Sequence
  BRev_15_GTGGAA-A_ov
attccacgtgtagatctcggtggtcg

SEQ ID NO: 1048 - DNA, 26 bp, Artificial Sequence
  BRev_16_TACGAG-A_ov
actcgtagtgtagatctcggtggtcg

SEQ ID NO: 1049 - DNA, 26 bp, Artificial Sequence
  BRev_17_ATCGAC-A_ov
agtcgatgtgtagatctcggtggtcg

SEQ ID NO: 1050 - DNA, 26 bp, Artificial Sequence
  BRev_18_TGTGAC-A_ov
agtcacagtgtagatctcggtggtcg

SEQ ID NO: 1051 - DNA, 26 bp, Artificial Sequence
  BRev_19_CAACAG-A_ov
actgttggtgtagatctcggtggtcg

SEQ ID NO: 1052 - DNA, 26 bp, Artificial Sequence
  BRev_20_GGACAT-A_ov
aatgtccgtgtagatctcggtggtcg

SEQ ID NO: 1053 - DNA, 26 bp, Artificial Sequence
  BRev_21_ACACAC-A_ov
agtgtgtgtgtagatctcggtggtcg

SEQ ID NO: 1054 - DNA, 26 bp, Artificial Sequence
  BRev_22_TAGCAC-A_ov
agtgctagtgtagatctcggtggtcg

SEQ ID NO: 1055 - DNA, 26 bp, Artificial Sequence
  BRev_23_ATGCAG-A_ov
actgcatgtgtagatctcggtggtcg

SEQ ID NO: 1056 - DNA, 26 bp, Artificial Sequence
  BRev_24_CTCCAA-A_ov
attggaggtgtagatctcggtggtcg

SEQ ID NO: 1057 - DNA, 26 bp, Artificial Sequence
  BRev_25_TCTCAG-A_ov
actgagagtgtagatctcggtggtcg

SEQ ID NO: 1058 - DNA, 26 bp, Artificial Sequence
  BRev_26_CGATAC-A_ov
agtatcggtgtagatctcggtggtcg

SEQ ID NO: 1059 - DNA, 26 bp, Artificial Sequence
  BRev_27_GCATAG-A_ov
actatgcgtgtagatctcggtggtcg

SEQ ID NO: 1060 - DNA, 26 bp, Artificial Sequence
  BRev_28_TGGTAG-A_ov
actaccagtgtagatctcggtggtcg

SEQ ID NO: 1061 - DNA, 26 bp, Artificial Sequence
  BRev_29_TCCTAC-A_ov
agtaggagtgtagatctcggtggtcg

SEQ ID NO: 1062 - DNA, 26 bp, Artificial Sequence
  BRev_30_CGAAGA-A_ov
atcttcggtgtagatctcggtggtcg

SEQ ID NO: 1063 - DNA, 26 bp, Artificial Sequence
  BRev_31_GCAAGT-A_ov
aacttgcgtgtagatctcggtggtcg

SEQ ID NO: 1064 - DNA, 26 bp, Artificial Sequence
  BRev_32_CAGAGT-A_ov
aactctggtgtagatctcggtggtcg

SEQ ID NO: 1065 - DNA, 26 bp, Artificial Sequence
  BRev_33_TTGAGG-A_ov
acctcaagtgtagatctcggtggtcg

SEQ ID NO: 1066 - DNA, 26 bp, Artificial Sequence
  BRev_34_AGCAGT-A_ov
aactgctgtgtagatctcggtggtcg

SEQ ID NO: 1067 - DNA, 26 bp, Artificial Sequence
  BRev_35_TCCAGA-A_ov
atctggagtgtagatctcggtggtcg

SEQ ID NO: 1068 - DNA, 26 bp, Artificial Sequence
  BRev_36_CTTAGC-A_ov
agctaaggtgtagatctcggtggtcg

SEQ ID NO: 1069 - DNA, 26 bp, Artificial Sequence
  BRev_37_TGAGGT-A_ov
aacctcagtgtagatctcggtggtcg

SEQ ID NO: 1070 - DNA, 26 bp, Artificial Sequence
  BRev_38_ACAGGA-A_ov
atcctgtgtgtagatctcggtggtcg

SEQ ID NO: 1071 - DNA, 26 bp, Artificial Sequence
  BRev_39_AATGGG-A_ov
acccattgtgtagatctcggtggtcg

SEQ ID NO: 1072 - DNA, 26 bp, Artificial Sequence
  BRev_40_GAACGA-A_ov
atcgttcgtgtagatctcggtggtcg

SEQ ID NO: 1073 - DNA, 26 bp, Artificial Sequence
  BRev_41_CTACGT-A_ov
aacgtaggtgtagatctcggtggtcg

SEQ ID NO: 1074 - DNA, 26 bp, Artificial Sequence
  BRev_42_TACCGT-A_ov
aacggtagtgtagatctcggtggtcg

SEQ ID NO: 1075 - DNA, 26 bp, Artificial Sequence
  BRev_43_AGTCGA-A_ov
atcgactgtgtagatctcggtggtcg

SEQ ID NO: 1076 - DNA, 26 bp, Artificial Sequence
  BRev_44_GTATGC-A_ov
agcatacgtgtagatctcggtggtcg

SEQ ID NO: 1077 - DNA, 26 bp, Artificial Sequence
  BRev_45_AAGTGC-A_ov
agcacttgtgtagatctcggtggtcg

SEQ ID NO: 1078 - DNA, 26 bp, Artificial Sequence
  BRev_46_TCGTGT-A_ov
aacacgagtgtagatctcggtggtcg

SEQ ID NO: 1079 - DNA, 26 bp, Artificial Sequence
  BRev_47_CTGTGA-A_ov
atcacaggtgtagatctcggtggtcg

SEQ ID NO: 1080 - DNA, 26 bp, Artificial Sequence
  BRev_48_ATCTGG-A_ov
accagatgtgtagatctcggtggtcg

SEQ ID NO: 1081 - DNA, 26 bp, Artificial Sequence
  BRev_49_CGTTGT-A_ov
aacaacggtgtagatctcggtggtcg

SEQ ID NO: 1082 - DNA, 26 bp, Artificial Sequence
  BRev_50_GCTTGA-A_ov
atcaagcgtgtagatctcggtggtcg

SEQ ID NO: 1083 - DNA, 26 bp, Artificial Sequence
  BRev_51_TGAACG-A_ov
acgttcagtgtagatctcggtggtcg

SEQ ID NO: 1084 - DNA, 26 bp, Artificial Sequence
  BRev_52_ACGACT-A_ov
aagtcgtgtgtagatctcggtggtcg

SEQ ID NO: 1085 - DNA, 26 bp, Artificial Sequence
  BRev_53_GACACT-A_ov
aagtgtcgtgtagatctcggtggtcg

SEQ ID NO: 1086 - DNA, 26 bp, Artificial Sequence
  BRev_54_TTCACC-A_ov
aggtgaagtgtagatctcggtggtcg

SEQ ID NO: 1087 - DNA, 26 bp, Artificial Sequence
  BRev_55_GTTACG-A_ov
acgtaacgtgtagatctcggtggtcg

SEQ ID NO: 1088 - DNA, 26 bp, Artificial Sequence
  BRev_56_CAAGCA-A_ov
atgcttggtgtagatctcggtggtcg

SEQ ID NO: 1089 - DNA, 26 bp, Artificial Sequence
  BRev_57_TAGGCT-A_ov
aagcctagtgtagatctcggtggtcg

SEQ ID NO: 1090 - DNA, 26 bp, Artificial Sequence
  BRev_58_AGTGCT-A_ov
aagcactgtgtagatctcggtggtcg

SEQ ID NO: 1091 - DNA, 26 bp, Artificial Sequence
  BRev_59_TCTGCA-A_ov
atgcagagtgtagatctcggtggtcg

SEQ ID NO: 1092 - DNA, 26 bp, Artificial Sequence
  BRev_60_TCACCT-A_ov
aaggtgagtgtagatctcggtggtcg

SEQ ID NO: 1093 - DNA, 26 bp, Artificial Sequence
  BRev_61_TTGCCA-A_ov
atggcaagtgtagatctcggtggtcg

SEQ ID NO: 1094 - DNA, 26 bp, Artificial Sequence
  BRev_62_CATCCT-A_ov
aaggatggtgtagatctcggtggtcg

SEQ ID NO: 1095 - DNA, 26 bp, Artificial Sequence
  BRev_63_ATTCCC-A_ov
agggaatgtgtagatctcggtggtcg

SEQ ID NO: 1096 - DNA, 26 bp, Artificial Sequence
  BRev_64_GGATCA-A_ov
atgatccgtgtagatctcggtggtcg

SEQ ID NO: 1097 - DNA, 26 bp, Artificial Sequence
  BRev_65_CTATCG-A_ov
acgataggtgtagatctcggtggtcg

SEQ ID NO: 1098 - DNA, 26 bp, Artificial Sequence
  BRev_66_GTGTCT-A_ov
aagacacgtgtagatctcggtggtcg

SEQ ID NO: 1099 - DNA, 26 bp, Artificial Sequence
  BRev_67_TGCTCT-A_ov
aagagcagtgtagatctcggtggtcg

SEQ ID NO: 1100 - DNA, 26 bp, Artificial Sequence
  BRev_68_ACCTCA-A_ov
atgaggtgtgtagatctcggtggtcg

SEQ ID NO: 1101 - DNA, 26 bp, Artificial Sequence
  BRev_69_GGAATC-A_ov
agattccgtgtagatctcggtggtcg

SEQ ID NO: 1102 - DNA, 26 bp, Artificial Sequence
  BRev_70_CCAATG-A_ov
acattgggtgtagatctcggtggtcg

SEQ ID NO: 1103 - DNA, 26 bp, Artificial Sequence
  BRev_71_TCGATC-A_ov
agatcgagtgtagatctcggtggtcg

SEQ ID NO: 1104 - DNA, 26 bp, Artificial Sequence
  BRev_72_GTAGTG-A_ov
acactacgtgtagatctcggtggtcg

SEQ ID NO: 1105 - DNA, 26 bp, Artificial Sequence
  BRev_73_CTGGTT-A_ov
aaaccaggtgtagatctcggtggtcg

SEQ ID NO: 1106 - DNA, 26 bp, Artificial Sequence
  BRev_74_GACGTA-A_ov
atacgtcgtgtagatctcggtggtcg

SEQ ID NO: 1107 - DNA, 26 bp, Artificial Sequence
  BRev_75_CGTGTA-A_ov
atacacggtgtagatctcggtggtcg

SEQ ID NO: 1108 - DNA, 26 bp, Artificial Sequence
  BRev_76_ACTGTC-A_ov
agacagtgtgtagatctcggtggtcg

SEQ ID NO: 1109 - DNA, 26 bp, Artificial Sequence
  BRev_77_CAGCTA-A_ov
atagctggtgtagatctcggtggtcg

SEQ ID NO: 1110 - DNA, 26 bp, Artificial Sequence
  BRev_78_AGGCTT-A_ov
aaagcctgtgtagatctcggtggtcg

SEQ ID NO: 1111 - DNA, 26 bp, Artificial Sequence
  BRev_79_AACCTG-A_ov
acaggttgtgtagatctcggtggtcg

SEQ ID NO: 1112 - DNA, 26 bp, Artificial Sequence
  BRev_80_TGCCTA-A_ov
ataggcagtgtagatctcggtggtcg

SEQ ID NO: 1113 - DNA, 26 bp, Artificial Sequence
  BRev_81_GTCCTT-A_ov
aaaggacgtgtagatctcggtggtcg

SEQ ID NO: 1114 - DNA, 26 bp, Artificial Sequence
  BRev_82_CTTCTG-A_ov
acagaaggtgtagatctcggtggtcg

SEQ ID NO: 1115 - DNA, 26 bp, Artificial Sequence
  BRev_83_ACGTTG-A_ov
acaacgtgtgtagatctcggtggtcg

SEQ ID NO: 1116 - DNA, 26 bp, Artificial Sequence
  BRev_84_AGCTTC-A_ov
agaagctgtgtagatctcggtggtcg

SEQ ID NO: 1117 - DNA, 26 bp, Artificial Sequence
  BRev_85_ACTCGT-A_ov
aacgagtgtgtagatctcggtggtcg

SEQ ID NO: 1118 - DNA, 26 bp, Artificial Sequence
  BRev_86_GATTCG-A_ov
acgaatcgtgtagatctcggtggtcg

SEQ ID NO: 1119 - DNA, 26 bp, Artificial Sequence
  BRev_87_CATTCC-A_ov
aggaatggtgtagatctcggtggtcg

SEQ ID NO: 1120 - DNA, 26 bp, Artificial Sequence
  BRev_88_CACTTG-A_ov
acaagtggtgtagatctcggtggtcg

SEQ ID NO: 1121 - DNA, 26 bp, Artificial Sequence
  BRev_89_CTCTTC-A_ov
agaagaggtgtagatctcggtggtcg

SEQ ID NO: 1122 - DNA, 26 bp, Artificial Sequence
  BRev_90_CTGTAC-A_ov
agtacaggtgtagatctcggtggtcg

SEQ ID NO: 1123 - DNA, 26 bp, Artificial Sequence
  BRev_91_GTCAGA-A_ov
atctgacgtgtagatctcggtggtcg

SEQ ID NO: 1124 - DNA, 26 bp, Artificial Sequence
  BRev_92_ACTAGG-A_ov
acctagtgtgtagatctcggtggtcg

SEQ ID NO: 1125 - DNA, 26 bp, Artificial Sequence
  BRev_93_TTAGGC-A_ov
agcctaagtgtagatctcggtggtcg

SEQ ID NO: 1126 - DNA, 26 bp, Artificial Sequence
  BRev_94_TATGGC-A_ov
agccatagtgtagatctcggtggtcg

SEQ ID NO: 1127 - DNA, 26 bp, Artificial Sequence
  BRev_95_TTACGG-A_ov
accgtaagtgtagatctcggtggtcg

SEQ ID NO: 1128 - DNA, 26 bp, Artificial Sequence
  BRev_96_CATTGG-A_ov
accaatggtgtagatctcggtggtcg

SEQ ID NO: 1129 - DNA, 26 bp, Artificial Sequence
  BRev_1_TCCGTT-C_ov
caacggagtgtagatctcggtggtcg

SEQ ID NO: 1130 - DNA, 26 bp, Artificial Sequence
  BRev_2_GTTGGT-C_ov
caccaacgtgtagatctcggtggtcg

SEQ ID NO: 1131 - DNA, 26 bp, Artificial Sequence
  BRev_3_GATCTC-C_ov
cgagatcgtgtagatctcggtggtcg

SEQ ID NO: 1132 - DNA, 26 bp, Artificial Sequence
  BRev_4_GAGAAG-C_ov
ccttctcgtgtagatctcggtggtcg

SEQ ID NO: 1133 - DNA, 26 bp, Artificial Sequence
  BRev_5_AGGAAC-C_ov
cgttcctgtgtagatctcggtggtcg

SEQ ID NO: 1134 - DNA, 26 bp, Artificial Sequence
  BRev_6_CCGAAA-C_ov
ctttcgggtgtagatctcggtggtcg

SEQ ID NO: 1135 - DNA, 26 bp, Artificial Sequence
  BRev_7_CACAAC-C_ov
cgttgtggtgtagatctcggtggtcg

SEQ ID NO: 1136 - DNA, 26 bp, Artificial Sequence
  BRev_8_GGCAAA-C_ov
ctttgccgtgtagatctcggtggtcg

SEQ ID NO: 1137 - DNA, 26 bp, Artificial Sequence
  BRev_9_ACCAAG-C_ov
ccttggtgtgtagatctcggtggtcg

SEQ ID NO: 1138 - DNA, 26 bp, Artificial Sequence
  BRev_10_CGTAAG-C_ov
ccttacggtgtagatctcggtggtcg

SEQ ID NO: 1139 - DNA, 26 bp, Artificial Sequence
  BRev_11_GCTAAC-C_ov
cgttagcgtgtagatctcggtggtcg

SEQ ID NO: 1140 - DNA, 26 bp, Artificial Sequence
  BRev_12_GAAGAC-C_ov
cgtcttcgtgtagatctcggtggtcg

SEQ ID NO: 1141 - DNA, 26 bp, Artificial Sequence
  BRev_13_AGAGAG-C_ov
cctctctgtgtagatctcggtggtcg

SEQ ID NO: 1142 - DNA, 26 bp, Artificial Sequence
  BRev_14_CCAGAT-C_ov
catctgggtgtagatctcggtggtcg

SEQ ID NO: 1143 - DNA, 26 bp, Artificial Sequence
  BRev_15_GTGGAA-C_ov
cttccacgtgtagatctcggtggtcg

SEQ ID NO: 1144 - DNA, 26 bp, Artificial Sequence
  BRev_16_TACGAG-C_ov
cctcgtagtgtagatctcggtggtcg

SEQ ID NO: 1145 - DNA, 26 bp, Artificial Sequence
  BRev_17_ATCGAC-C_ov
cgtcgatgtgtagatctcggtggtcg

SEQ ID NO: 1146 - DNA, 26 bp, Artificial Sequence
  BRev_18_TGTGAC-C_ov
cgtcacagtgtagatctcggtggtcg

SEQ ID NO: 1147 - DNA, 26 bp, Artificial Sequence
  BRev_19_CAACAG-C_ov
cctgttggtgtagatctcggtggtcg

SEQ ID NO: 1148 - DNA, 26 bp, Artificial Sequence
  BRev_20_GGACAT-C_ov
catgtccgtgtagatctcggtggtcg

SEQ ID NO: 1149 - DNA, 26 bp, Artificial Sequence
  BRev_21_ACACAC-C_ov
cgtgtgtgtgtagatctcggtggtcg

SEQ ID NO: 1150 - DNA, 26 bp, Artificial Sequence
  BRev_22_TAGCAC-C_ov
cgtgctagtgtagatctcggtggtcg

SEQ ID NO: 1151 - DNA, 26 bp, Artificial Sequence
  BRev_23_ATGCAG-C_ov
cctgcatgtgtagatctcggtggtcg

SEQ ID NO: 1152 - DNA, 26 bp, Artificial Sequence
  BRev_24_CTCCAA-C_ov
cttggaggtgtagatctcggtggtcg

SEQ ID NO: 1153 - DNA, 26 bp, Artificial Sequence
  BRev_25_TCTCAG-C_ov
cctgagagtgtagatctcggtggtcg

SEQ ID NO: 1154 - DNA, 26 bp, Artificial Sequence
  BRev_26_CGATAC-C_ov
cgtatcggtgtagatctcggtggtcg

SEQ ID NO: 1155 - DNA, 26 bp, Artificial Sequence
  BRev_27_GCATAG-C_ov
cctatgcgtgtagatctcggtggtcg

SEQ ID NO: 1156 - DNA, 26 bp, Artificial Sequence
  BRev_28_TGGTAG-C_ov
cctaccagtgtagatctcggtggtcg

SEQ ID NO: 1157 - DNA, 26 bp, Artificial Sequence
  BRev_29_TCCTAC-C_ov
cgtaggagtgtagatctcggtggtcg

SEQ ID NO: 1158 - DNA, 26 bp, Artificial Sequence
  BRev_30_CGAAGA-C_ov
ctcttcggtgtagatctcggtggtcg

SEQ ID NO: 1159 - DNA, 26 bp, Artificial Sequence
  BRev_31_GCAAGT-C_ov
cacttgcgtgtagatctcggtggtcg

SEQ ID NO: 1160 - DNA, 26 bp, Artificial Sequence
  BRev_32_CAGAGT-C_ov
cactctggtgtagatctcggtggtcg

SEQ ID NO: 1161 - DNA, 26 bp, Artificial Sequence
  BRev_33_TTGAGG-C_ov
ccctcaagtgtagatctcggtggtcg

SEQ ID NO: 1162 - DNA, 26 bp, Artificial Sequence
  BRev_34_AGCAGT-C_ov
cactgctgtgtagatctcggtggtcg

SEQ ID NO: 1163 - DNA, 26 bp, Artificial Sequence
  BRev_35_TCCAGA-C_ov
ctctggagtgtagatctcggtggtcg

SEQ ID NO: 1164 - DNA, 26 bp, Artificial Sequence
  BRev_36_CTTAGC-C_ov
cgctaaggtgtagatctcggtggtcg

SEQ ID NO: 1165 - DNA, 26 bp, Artificial Sequence
  BRev_37_TGAGGT-C_ov
cacctcagtgtagatctcggtggtcg

SEQ ID NO: 1166 - DNA, 26 bp, Artificial Sequence
  BRev_38_ACAGGA-C_ov
ctcctgtgtgtagatctcggtggtcg

SEQ ID NO: 1167 - DNA, 26 bp, Artificial Sequence
  BRev_39_AATGGG-C_ov
ccccattgtgtagatctcggtggtcg

SEQ ID NO: 1168 - DNA, 26 bp, Artificial Sequence
  BRev_40_GAACGA-C_ov
ctcgttcgtgtagatctcggtggtcg

SEQ ID NO: 1169 - DNA, 26 bp, Artificial Sequence
  BRev_41_CTACGT-C_ov
cacgtaggtgtagatctcggtggtcg

SEQ ID NO: 1170 - DNA, 26 bp, Artificial Sequence
  BRev_42_TACCGT-C_ov
cacggtagtgtagatctcggtggtcg

SEQ ID NO: 1171 - DNA, 26 bp, Artificial Sequence
  BRev_43_AGTCGA-C_ov
ctcgactgtgtagatctcggtggtcg

SEQ ID NO: 1172 - DNA, 26 bp, Artificial Sequence
  BRev_44_GTATGC-C_ov
cgcatacgtgtagatctcggtggtcg

SEQ ID NO: 1173 - DNA, 26 bp, Artificial Sequence
  BRev_45_AAGTGC-C_ov
cgcacttgtgtagatctcggtggtcg

SEQ ID NO: 1174 - DNA, 26 bp, Artificial Sequence
  BRev_46_TCGTGT-C_ov
cacacgagtgtagatctcggtggtcg

SEQ ID NO: 1175 - DNA, 26 bp, Artificial Sequence
  BRev_47_CTGTGA-C_ov
ctcacaggtgtagatctcggtggtcg

SEQ ID NO: 1176 - DNA, 26 bp, Artificial Sequence
  BRev_48_ATCTGG-C_ov
cccagatgtgtagatctcggtggtcg

SEQ ID NO: 1177 - DNA, 26 bp, Artificial Sequence
  BRev_49_CGTTGT-C_ov
cacaacggtgtagatctcggtggtcg

SEQ ID NO: 1178 - DNA, 26 bp, Artificial Sequence
  BRev_50_GCTTGA-C_ov
ctcaagcgtgtagatctcggtggtcg

SEQ ID NO: 1179 - DNA, 26 bp, Artificial Sequence
  BRev_51_TGAACG-C_ov
ccgttcagtgtagatctcggtggtcg

SEQ ID NO: 1180 - DNA, 26 bp, Artificial Sequence
  BRev_52_ACGACT-C_ov
cagtcgtgtgtagatctcggtggtcg

SEQ ID NO: 1181 - DNA, 26 bp, Artificial Sequence
  BRev_53_GACACT-C_ov
cagtgtcgtgtagatctcggtggtcg

SEQ ID NO: 1182 - DNA, 26 bp, Artificial Sequence
  BRev_54_TTCACC-C_ov
cggtgaagtgtagatctcggtggtcg

SEQ ID NO: 1183 - DNA, 26 bp, Artificial Sequence
  BRev_55_GTTACG-C_ov
ccgtaacgtgtagatctcggtggtcg

SEQ ID NO: 1184 - DNA, 26 bp, Artificial Sequence
  BRev_56_CAAGCA-C_ov
ctgcttggtgtagatctcggtggtcg

SEQ ID NO: 1185 - DNA, 26 bp, Artificial Sequence
  BRev_57_TAGGCT-C_ov
cagcctagtgtagatctcggtggtcg

SEQ ID NO: 1186 - DNA, 26 bp, Artificial Sequence
  BRev_58_AGTGCT-C_ov
cagcactgtgtagatctcggtggtcg

SEQ ID NO: 1187 - DNA, 26 bp, Artificial Sequence
  BRev_59_TCTGCA-C_ov
ctgcagagtgtagatctcggtggtcg

SEQ ID NO: 1188 - DNA, 26 bp, Artificial Sequence
  BRev_60_TCACCT-C_ov
caggtgagtgtagatctcggtggtcg

SEQ ID NO: 1189 - DNA, 26 bp, Artificial Sequence
  BRev_61_TTGCCA-C_ov
ctggcaagtgtagatctcggtggtcg

SEQ ID NO: 1190 - DNA, 26 bp, Artificial Sequence
  BRev_62_CATCCT-C_ov
caggatggtgtagatctcggtggtcg

SEQ ID NO: 1191 - DNA, 26 bp, Artificial Sequence
  BRev_63_ATTCCC-C_ov
cgggaatgtgtagatctcggtggtcg

SEQ ID NO: 1192 - DNA, 26 bp, Artificial Sequence
  BRev_64_GGATCA-C_ov
ctgatccgtgtagatctcggtggtcg

SEQ ID NO: 1193 - DNA, 26 bp, Artificial Sequence
  BRev_65_CTATCG-C_ov
ccgataggtgtagatctcggtggtcg

SEQ ID NO: 1194 - DNA, 26 bp, Artificial Sequence
  BRev_66_GTGTCT-C_ov
cagacacgtgtagatctcggtggtcg

SEQ ID NO: 1195 - DNA, 26 bp, Artificial Sequence
  BRev_67_TGCTCT-C_ov
cagagcagtgtagatctcggtggtcg

SEQ ID NO: 1196 - DNA, 26 bp, Artificial Sequence
  BRev_68_ACCTCA-C_ov
ctgaggtgtgtagatctcggtggtcg

SEQ ID NO: 1197 - DNA, 26 bp, Artificial Sequence
  BRev_69_GGAATC-C_ov
cgattccgtgtagatctcggtggtcg

SEQ ID NO: 1198 - DNA, 26 bp, Artificial Sequence
  BRev_70_CCAATG-C_ov
ccattgggtgtagatctcggtggtcg

SEQ ID NO: 1199 - DNA, 26 bp, Artificial Sequence
  BRev_71_TCGATC-C_ov
cgatcgagtgtagatctcggtggtcg

SEQ ID NO: 1200 - DNA, 26 bp, Artificial Sequence
  BRev_72_GTAGTG-C_ov
ccactacgtgtagatctcggtggtcg

SEQ ID NO: 1201 - DNA, 26 bp, Artificial Sequence
  BRev_73_CTGGTT-C_ov
caaccaggtgtagatctcggtggtcg

SEQ ID NO: 1202 - DNA, 26 bp, Artificial Sequence
  BRev_74_GACGTA-C_ov
ctacgtcgtgtagatctcggtggtcg

SEQ ID NO: 1203 - DNA, 26 bp, Artificial Sequence
  BRev_75_CGTGTA-C_ov
ctacacggtgtagatctcggtggtcg

SEQ ID NO: 1204 - DNA, 26 bp, Artificial Sequence
  BRev_76_ACTGTC-C_ov
cgacagtgtgtagatctcggtggtcg

SEQ ID NO: 1205 - DNA, 26 bp, Artificial Sequence
  BRev_77_CAGCTA-C_ov
ctagctggtgtagatctcggtggtcg

SEQ ID NO: 1206 - DNA, 26 bp, Artificial Sequence
  BRev_78_AGGCTT-C_ov
caagcctgtgtagatctcggtggtcg

SEQ ID NO: 1207 - DNA, 26 bp, Artificial Sequence
  BRev_79_AACCTG-C_ov
ccaggttgtgtagatctcggtggtcg

SEQ ID NO: 1208 - DNA, 26 bp, Artificial Sequence
  BRev_80_TGCCTA-C_ov
ctaggcagtgtagatctcggtggtcg

SEQ ID NO: 1209 - DNA, 26 bp, Artificial Sequence
  BRev_81_GTCCTT-C_ov
caaggacgtgtagatctcggtggtcg

SEQ ID NO: 1210 - DNA, 26 bp, Artificial Sequence
  BRev_82_CTTCTG-C_ov
ccagaaggtgtagatctcggtggtcg

SEQ ID NO: 1211 - DNA, 26 bp, Artificial Sequence
  BRev_83_ACGTTG-C_ov
ccaacgtgtgtagatctcggtggtcg

SEQ ID NO: 1212 - DNA, 26 bp, Artificial Sequence
  BRev_84_AGCTTC-C_ov
cgaagctgtgtagatctcggtggtcg

SEQ ID NO: 1213 - DNA, 26 bp, Artificial Sequence
  BRev_85_ACTCGT-C_ov
cacgagtgtgtagatctcggtggtcg

SEQ ID NO: 1214 - DNA, 26 bp, Artificial Sequence
  BRev_86_GATTCG-C_ov
ccgaatcgtgtagatctcggtggtcg

SEQ ID NO: 1215 - DNA, 26 bp, Artificial Sequence
  BRev_87_CATTCC-C_ov
cggaatggtgtagatctcggtggtcg

SEQ ID NO: 1216 - DNA, 26 bp, Artificial Sequence
  BRev_88_CACTTG-C_ov
ccaagtggtgtagatctcggtggtcg

SEQ ID NO: 1217 - DNA, 26 bp, Artificial Sequence
  BRev_89_CTCTTC-C_ov
cgaagaggtgtagatctcggtggtcg

SEQ ID NO: 1218 - DNA, 26 bp, Artificial Sequence
  BRev_90_CTGTAC-C_ov
cgtacaggtgtagatctcggtggtcg

SEQ ID NO: 1219 - DNA, 26 bp, Artificial Sequence
  BRev_91_GTCAGA-C_ov
ctctgacgtgtagatctcggtggtcg

SEQ ID NO: 1220 - DNA, 26 bp, Artificial Sequence
  BRev_92_ACTAGG-C_ov
ccctagtgtgtagatctcggtggtcg

SEQ ID NO: 1221 - DNA, 26 bp, Artificial Sequence
  BRev_93_TTAGGC-C_ov
cgcctaagtgtagatctcggtggtcg

SEQ ID NO: 1222 - DNA, 26 bp, Artificial Sequence
  BRev_94_TATGGC-C_ov
cgccatagtgtagatctcggtggtcg

SEQ ID NO: 1223 - DNA, 26 bp, Artificial Sequence
  BRev_95_TTACGG-C_ov
cccgtaagtgtagatctcggtggtcg

SEQ ID NO: 1224 - DNA, 26 bp, Artificial Sequence
  BRev_96_CATTGG-C_ov
cccaatggtgtagatctcggtggtcg

SEQ ID NO: 1225 - DNA, 41 bp, Artificial Sequence
  CFor_1_CGTTTC-T_ov
  modified_base 1: /mod_base="OTHER" /note="5'-phosphorylation"
tcgtttcgtctcgtgggctcggagatgtgtataagagacag

SEQ ID NO: 1226 - DNA, 41 bp, Artificial Sequence
  CFor_2_TGGTGT-T_ov
  modified_base 1: /mod_base="OTHER" /note="5'-phosphorylation"
ttggtgtgtctcgtgggctcggagatgtgtataagagacag

SEQ ID NO: 1227 - DNA, 41 bp, Artificial Sequence
  CFor_3_TCTCGA-T_ov
  modified_base 1: /mod_base="OTHER" /note="5'-phosphorylation"
ttctcgagtctcgtgggctcggagatgtgtataagagacag

SEQ ID NO: 1228 - DNA, 41 bp, Artificial Sequence
  CFor_4_GAAGGA-T_ov
  modified_base 1: /mod_base="OTHER" /note="5'-phosphorylation"
tgaaggagtctcgtgggctcggagatgtgtataagagacag

SEQ ID NO: 1229 - DNA, 41 bp, Artificial Sequence
  CFor_5_GAACAG-T_ov
  modified_base 1: /mod_base="OTHER" /note="5'-phosphorylation"
tgaacaggtctcgtgggctcggagatgtgtataagagacag

SEQ ID NO: 1230 - DNA, 41 bp, Artificial Sequence
  CFor_6_GAAACC-T_ov
  modified_base 1: /mod_base="OTHER" /note="5'-phosphorylation"
tgaaaccgtctcgtgggctcggagatgtgtataagagacag

SEQ ID NO: 1231 - DNA, 41 bp, Artificial Sequence
  CFor_7_CAACCA-T_ov
  modified_base 1: /mod_base="OTHER" /note="5'-phosphorylation"
tcaaccagtctcgtgggctcggagatgtgtataagagacag

SEQ ID NO: 1232 - DNA, 41 bp, Artificial Sequence
  CFor_8_CAAAGG-T_ov
  modified_base 1: /mod_base="OTHER" /note="5'-phosphorylation"
tcaaagggtctcgtgggctcggagatgtgtataagagacag

SEQ ID NO: 1233 - DNA, 41 bp, Artificial Sequence
  CFor_9_CAAGAC-T_ov
  modified_base 1: /mod_base="OTHER" /note="5'-phosphorylation"
tcaagacgtctcgtgggctcggagatgtgtataagagacag

SEQ ID NO: 1234 - DNA, 41 bp, Artificial Sequence
  CFor_10_TAAGCG-T_ov
  modified_base 1: /mod_base="OTHER" /note="5'-phosphorylation"
ttaagcggtctcgtgggctcggagatgtgtataagagacag

SEQ ID NO: 1235 - DNA, 41 bp, Artificial Sequence
  CFor_11_TAACGC-T_ov
  modified_base 1: /mod_base="OTHER" /note="5'-phosphorylation"
ttaacgcgtctcgtgggctcggagatgtgtataagagacag

SEQ ID NO: 1236 - DNA, 41 bp, Artificial Sequence
  CFor_12_AGACGA-T_ov
  modified_base 1: /mod_base="OTHER" /note="5'-phosphorylation"
tagacgagtctcgtgggctcggagatgtgtataagagacag

SEQ ID NO: 1237 - DNA, 41 bp, Artificial Sequence
  CFor_13_AGAGAG-T_ov
  modified_base 1: /mod_base="OTHER" /note="5'-phosphorylation"
tagagaggtctcgtgggctcggagatgtgtataagagacag

SEQ ID NO: 1238 - DNA, 41 bp, Artificial Sequence
  CFor_14_AGATCC-T_ov
  modified_base 1: /mod_base="OTHER" /note="5'-phosphorylation"
tagatccgtctcgtgggctcggagatgtgtataagagacag

SEQ ID NO: 1239 - DNA, 41 bp, Artificial Sequence
  CFor_15_GGAAGT-T_ov
  modified_base 1: /mod_base="OTHER" /note="5'-phosphorylation"
tggaagtgtctcgtgggctcggagatgtgtataagagacag

SEQ ID NO: 1240 - DNA, 41 bp, Artificial Sequence
  CFor_16_CGAGTA-T_ov
  modified_base 1: /mod_base="OTHER" /note="5'-phosphorylation"
tcgagtagtctcgtgggctcggagatgtgtataagagacag

SEQ ID NO: 1241 - DNA, 41 bp, Artificial Sequence
  CFor_17_CGACAT-T_ov
  modified_base 1: /mod_base="OTHER" /note="5'-phosphorylation"
tcgacatgtctcgtgggctcggagatgtgtataagagacag

SEQ ID NO: 1242 - DNA, 41 bp, Artificial Sequence
  CFor_18_TGACTG-T_ov
  modified_base 1: /mod_base="OTHER" /note="5'-phosphorylation"
ttgactggtctcgtgggctcggagatgtgtataagagacag

SEQ ID NO: 1243 - DNA, 41 bp, Artificial Sequence
  CFor_19_ACAGCA-T_ov
  modified_base 1: /mod_base="OTHER" /note="5'-phosphorylation"
tacagcagtctcgtgggctcggagatgtgtataagagacag

SEQ ID NO: 1244 - DNA, 41 bp, Artificial Sequence
  CFor_20_ACATGG-T_ov
  modified_base 1: /mod_base="OTHER" /note="5'-phosphorylation"
tacatgggtctcgtgggctcggagatgtgtataagagacag

SEQ ID NO: 1245 - DNA, 41 bp, Artificial Sequence
  CFor_21_ACACAC-T_ov
  modified_base 1: /mod_base="OTHER" /note="5'-phosphorylation"
tacacacgtctcgtgggctcggagatgtgtataagagacag

SEQ ID NO: 1246 - DNA, 41 bp, Artificial Sequence
  CFor_22_GCACTA-T_ov
  modified_base 1: /mod_base="OTHER" /note="5'-phosphorylation"
tgcactagtctcgtgggctcggagatgtgtataagagacag

SEQ ID NO: 1247 - DNA, 41 bp, Artificial Sequence
  CFor_23_GCAGAT-T_ov
  modified_base 1: /mod_base="OTHER" /note="5'-phosphorylation"
tgcagatgtctcgtgggctcggagatgtgtataagagacag

SEQ ID NO: 1248 - DNA, 41 bp, Artificial Sequence
  CFor_24_CCAACT-T_ov
  modified_base 1: /mod_base="OTHER" /note="5'-phosphorylation"
tccaactgtctcgtgggctcggagatgtgtataagagacag

SEQ ID NO: 1249 - DNA, 41 bp, Artificial Sequence
  CFor_25_TCAGTC-T_ov
  modified_base 1: /mod_base="OTHER" /note="5'-phosphorylation"
ttcagtcgtctcgtgggctcggagatgtgtataagagacag

SEQ ID NO: 1250 - DNA, 41 bp, Artificial Sequence
  CFor_26_ATACCG-T_ov
  modified_base 1: /mod_base="OTHER" /note="5'-phosphorylation"
tataccggtctcgtgggctcggagatgtgtataagagacag

SEQ ID NO: 1251 - DNA, 41 bp, Artificial Sequence
  CFor_27_ATAGGC-T_ov
  modified_base 1: /mod_base="OTHER" /note="5'-phosphorylation"
tataggcgtctcgtgggctcggagatgtgtataagagacag

SEQ ID NO: 1252 - DNA, 41 bp, Artificial Sequence
  CFor_28_GTAGTG-T_ov
  modified_base 1: /mod_base="OTHER" /note="5'-phosphorylation"
tgtagtggtctcgtgggctcggagatgtgtataagagacag

SEQ ID NO: 1253 - DNA, 41 bp, Artificial Sequence
  CFor_29_CTACTC-T_ov
  modified_base 1: /mod_base="OTHER" /note="5'-phosphorylation"
tctactcgtctcgtgggctcggagatgtgtataagagacag

SEQ ID NO: 1254 - DNA, 41 bp, Artificial Sequence
  CFor_30_AAGACG-T_ov
  modified_base 1: /mod_base="OTHER" /note="5'-phosphorylation"
taagacggtctcgtgggctcggagatgtgtataagagacag

SEQ ID NO: 1255 - DNA, 41 bp, Artificial Sequence
  CFor_31_AAGTGC-T_ov
  modified_base 1: /mod_base="OTHER" /note="5'-phosphorylation"
taagtgcgtctcgtgggctcggagatgtgtataagagacag

SEQ ID NO: 1256 - DNA, 41 bp, Artificial Sequence
  CFor_32_GAGTCA-T_ov
  modified_base 1: /mod_base="OTHER" /note="5'-phosphorylation"
tgagtcagtctcgtgggctcggagatgtgtataagagacag

SEQ ID NO: 1257 - DNA, 41 bp, Artificial Sequence
  CFor_33_GAGGTT-T_ov
  modified_base 1: /mod_base="OTHER" /note="5'-phosphorylation"
tgaggttgtctcgtgggctcggagatgtgtataagagacag

SEQ ID NO: 1258 - DNA, 41 bp, Artificial Sequence
  CFor_34_CAGTAG-T_ov
  modified_base 1: /mod_base="OTHER" /note="5'-phosphorylation"
tcagtaggtctcgtgggctcggagatgtgtataagagacag

SEQ ID NO: 1259 - DNA, 41 bp, Artificial Sequence
  CFor_35_CAGATC-T_ov
  modified_base 1: /mod_base="OTHER" /note="5'-phosphorylation"
tcagatcgtctcgtgggctcggagatgtgtataagagacag

SEQ ID NO: 1260 - DNA, 41 bp, Artificial Sequence
  CFor_36_TAGCCT-T_ov
  modified_base 1: /mod_base="OTHER" /note="5'-phosphorylation"
ttagcctgtctcgtgggctcggagatgtgtataagagacag

SEQ ID NO: 1261 - DNA, 41 bp, Artificial Sequence
  CFor_37_AGGTTG-T_ov
  modified_base 1: /mod_base="OTHER" /note="5'-phosphorylation"
taggttggtctcgtgggctcggagatgtgtataagagacag

SEQ ID NO: 1262 - DNA, 41 bp, Artificial Sequence
  CFor_38_AGGAAC-T_ov
  modified_base 1: /mod_base="OTHER" /note="5'-phosphorylation"
taggaacgtctcgtgggctcggagatgtgtataagagacag

SEQ ID NO: 1263 - DNA, 41 bp, Artificial Sequence
  CFor_39_TGGGAA-T_ov
  modified_base 1: /mod_base="OTHER" /note="5'-phosphorylation"
ttgggaagtctcgtgggctcggagatgtgtataagagacag

SEQ ID NO: 1264 - DNA, 41 bp, Artificial Sequence
  CFor_40_ACGAGA-T_ov
  modified_base 1: /mod_base="OTHER" /note="5'-phosphorylation"
tacgagagtctcgtgggctcggagatgtgtataagagacag

SEQ ID NO: 1265 - DNA, 41 bp, Artificial Sequence
  CFor_41_ACGTCT-T_ov
  modified_base 1: /mod_base="OTHER" /note="5'-phosphorylation"
tacgtctgtctcgtgggctcggagatgtgtataagagacag

SEQ ID NO: 1266 - DNA, 41 bp, Artificial Sequence
  CFor_42_CCGTTA-T_ov
  modified_base 1: /mod_base="OTHER" /note="5'-phosphorylation"
tccgttagtctcgtgggctcggagatgtgtataagagacag

SEQ ID NO: 1267 - DNA, 41 bp, Artificial Sequence
  CFor_43_TCGAAG-T_ov
  modified_base 1: /mod_base="OTHER" /note="5'-phosphorylation"
ttcgaaggtctcgtgggctcggagatgtgtataagagacag

SEQ ID NO: 1268 - DNA, 41 bp, Artificial Sequence
  CFor_44_ATGCGT-T_ov
  modified_base 1: /mod_base="OTHER" /note="5'-phosphorylation"
tatgcgtgtctcgtgggctcggagatgtgtataagagacag

SEQ ID NO: 1269 - DNA, 41 bp, Artificial Sequence
  CFor_45_GTGCAA-T_ov
  modified_base 1: /mod_base="OTHER" /note="5'-phosphorylation"
tgtgcaagtctcgtgggctcggagatgtgtataagagacag

SEQ ID NO: 1270 - DNA, 41 bp, Artificial Sequence
  CFor_46_GTGTTC-T_ov
  modified_base 1: /mod_base="OTHER" /note="5'-phosphorylation"
tgtgttcgtctcgtgggctcggagatgtgtataagagacag

SEQ ID NO: 1271 - DNA, 41 bp, Artificial Sequence
  CFor_47_GTGACT-T_ov
  modified_base 1: /mod_base="OTHER" /note="5'-phosphorylation"
tgtgactgtctcgtgggctcggagatgtgtataagagacag

SEQ ID NO: 1272 - DNA, 41 bp, Artificial Sequence
  CFor_48_CTGGAT-T_ov
  modified_base 1: /mod_base="OTHER" /note="5'-phosphorylation"
tctggatgtctcgtgggctcggagatgtgtataagagacag

SEQ ID NO: 1273 - DNA, 41 bp, Artificial Sequence
  CFor_49_TTGTCG-T_ov
  modified_base 1: /mod_base="OTHER" /note="5'-phosphorylation"
tttgtcggtctcgtgggctcggagatgtgtataagagacag

SEQ ID NO: 1274 - DNA, 41 bp, Artificial Sequence
  CFor_50_TTGAGC-T_ov
  modified_base 1: /mod_base="OTHER" /note="5'-phosphorylation"
tttgagcgtctcgtgggctcggagatgtgtataagagacag

SEQ ID NO: 1275 - DNA, 41 bp, Artificial Sequence
  CFor_51_AACGTG-T_ov
  modified_base 1: /mod_base="OTHER" /note="5'-phosphorylation"
taacgtggtctcgtgggctcggagatgtgtataagagacag

SEQ ID NO: 1276 - DNA, 41 bp, Artificial Sequence
  CFor_52_GACTAC-T_ov
  modified_base 1: /mod_base="OTHER" /note="5'-phosphorylation"
tgactacgtctcgtgggctcggagatgtgtataagagacag

SEQ ID NO: 1277 - DNA, 41 bp, Artificial Sequence
  CFor_53_CACTGA-T_ov
  modified_base 1: /mod_base="OTHER" /note="5'-phosphorylation"
tcactgagtctcgtgggctcggagatgtgtataagagacag

SEQ ID NO: 1278 - DNA, 41 bp, Artificial Sequence
  CFor_54_CACCTT-T_ov
  modified_base 1: /mod_base="OTHER" /note="5'-phosphorylation"
tcaccttgtctcgtgggctcggagatgtgtataagagacag

SEQ ID NO: 1279 - DNA, 41 bp, Artificial Sequence
  CFor_55_TACGGT-T_ov
  modified_base 1: /mod_base="OTHER" /note="5'-phosphorylation"
ttacggtgtctcgtgggctcggagatgtgtataagagacag

SEQ ID NO: 1280 - DNA, 41 bp, Artificial Sequence
  CFor_56_AGCACA-T_ov
  modified_base 1: /mod_base="OTHER" /note="5'-phosphorylation"
tagcacagtctcgtgggctcggagatgtgtataagagacag

SEQ ID NO: 1281 - DNA, 41 bp, Artificial Sequence
  CFor_57_GGCTTA-T_ov
  modified_base 1: /mod_base="OTHER" /note="5'-phosphorylation"
tggcttagtctcgtgggctcggagatgtgtataagagacag

SEQ ID NO: 1282 - DNA, 41 bp, Artificial Sequence
  CFor_58_TGCTAG-T_ov
  modified_base 1: /mod_base="OTHER" /note="5'-phosphorylation"
ttgctaggtctcgtgggctcggagatgtgtataagagacag

SEQ ID NO: 1283 - DNA, 41 bp, Artificial Sequence
  CFor_59_TGCATC-T_ov
  modified_base 1: /mod_base="OTHER" /note="5'-phosphorylation"
ttgcatcgtctcgtgggctcggagatgtgtataagagacag

SEQ ID NO: 1284 - DNA, 41 bp, Artificial Sequence
  CFor_60_ACCTTC-T_ov
  modified_base 1: /mod_base="OTHER" /note="5'-phosphorylation"
taccttcgtctcgtgggctcggagatgtgtataagagacag

SEQ ID NO: 1285 - DNA, 41 bp, Artificial Sequence
  CFor_61_GCCATT-T_ov
  modified_base 1: /mod_base="OTHER" /note="5'-phosphorylation"
tgccattgtctcgtgggctcggagatgtgtataagagacag

SEQ ID NO: 1286 - DNA, 41 bp, Artificial Sequence
  CFor_62_TCCTCA-T_ov
  modified_base 1: /mod_base="OTHER" /note="5'-phosphorylation"
ttcctcagtctcgtgggctcggagatgtgtataagagacag

SEQ ID NO: 1287 - DNA, 41 bp, Artificial Sequence
  CFor_63_TCCCAT-T_ov
  modified_base 1: /mod_base="OTHER" /note="5'-phosphorylation"
ttcccatgtctcgtgggctcggagatgtgtataagagacag

SEQ ID NO: 1288 - DNA, 41 bp, Artificial Sequence
  CFor_64_ATCAGG-T_ov
  modified_base 1: /mod_base="OTHER" /note="5'-phosphorylation"
tatcagggtctcgtgggctcggagatgtgtataagagacag

SEQ ID NO: 1289 - DNA, 41 bp, Artificial Sequence
  CFor_65_ATCGCT-T_ov
  modified_base 1: /mod_base="OTHER" /note="5'-phosphorylation"
tatcgctgtctcgtgggctcggagatgtgtataagagacag

SEQ ID NO: 1290 - DNA, 41 bp, Artificial Sequence
  CFor_66_GTCTGT-T_ov
  modified_base 1: /mod_base="OTHER" /note="5'-phosphorylation"
tgtctgtgtctcgtgggctcggagatgtgtataagagacag

SEQ ID NO: 1291 - DNA, 41 bp, Artificial Sequence
  CFor_67_CTCTTG-T_ov
  modified_base 1: /mod_base="OTHER" /note="5'-phosphorylation"
tctcttggtctcgtgggctcggagatgtgtataagagacag

SEQ ID NO: 1292 - DNA, 41 bp, Artificial Sequence
  CFor_68_CTCAAC-T_ov
  modified_base 1: /mod_base="OTHER" /note="5'-phosphorylation"
tctcaacgtctcgtgggctcggagatgtgtataagagacag

SEQ ID NO: 1293 - DNA, 41 bp, Artificial Sequence
  CFor_69_AATCGG-T_ov
  modified_base 1: /mod_base="OTHER" /note="5'-phosphorylation"
taatcgggtctcgtgggctcggagatgtgtataagagacag

SEQ ID NO: 1294 - DNA, 41 bp, Artificial Sequence
  CFor_70_AATGCC-T_ov
  modified_base 1: /mod_base="OTHER" /note="5'-phosphorylation"
taatgccgtctcgtgggctcggagatgtgtataagagacag

SEQ ID NO: 1295 - DNA, 41 bp, Artificial Sequence
  CFor_71_GATCTC-T_ov
  modified_base 1: /mod_base="OTHER" /note="5'-phosphorylation"
tgatctcgtctcgtgggctcggagatgtgtataagagacag

SEQ ID NO: 1296 - DNA, 41 bp, Artificial Sequence
  CFor_72_AGTGGT-T_ov
  modified_base 1: /mod_base="OTHER" /note="5'-phosphorylation"
tagtggtgtctcgtgggctcggagatgtgtataagagacag

SEQ ID NO: 1297 - DNA, 41 bp, Artificial Sequence
  CFor_73_GGTTCT-T_ov
  modified_base 1: /mod_base="OTHER" /note="5'-phosphorylation"
tggttctgtctcgtgggctcggagatgtgtataagagacag

SEQ ID NO: 1298 - DNA, 41 bp, Artificial Sequence
  CFor_74_CGTAGA-T_ov
  modified_base 1: /mod_base="OTHER" /note="5'-phosphorylation"
tcgtagagtctcgtgggctcggagatgtgtataagagacag

SEQ ID NO: 1299 - DNA, 41 bp, Artificial Sequence
  CFor_75_TGTACG-T_ov
  modified_base 1: /mod_base="OTHER" /note="5'-phosphorylation"
ttgtacggtctcgtgggctcggagatgtgtataagagacag

SEQ ID NO: 1300 - DNA, 41 bp, Artificial Sequence
  CFor_76_TGTCAC-T_ov
  modified_base 1: /mod_base="OTHER" /note="5'-phosphorylation"
ttgtcacgtctcgtgggctcggagatgtgtataagagacag

SEQ ID NO: 1301 - DNA, 41 bp, Artificial Sequence
  CFor_77_GCTACA-T_ov
  modified_base 1: /mod_base="OTHER" /note="5'-phosphorylation"
tgctacagtctcgtgggctcggagatgtgtataagagacag

SEQ ID NO: 1302 - DNA, 41 bp, Artificial Sequence
  CFor_78_GCTTAG-T_ov
  modified_base 1: /mod_base="OTHER" /note="5'-phosphorylation"
tgcttaggtctcgtgggctcggagatgtgtataagagacag

SEQ ID NO: 1303 - DNA, 41 bp, Artificial Sequence
  CFor_79_CCTGAA-T_ov
  modified_base 1: /mod_base="OTHER" /note="5'-phosphorylation"
tcctgaagtctcgtgggctcggagatgtgtataagagacag

SEQ ID NO: 1304 - DNA, 41 bp, Artificial Sequence
  CFor_80_CCTATG-T_ov
  modified_base 1: /mod_base="OTHER" /note="5'-phosphorylation"
tcctatggtctcgtgggctcggagatgtgtataagagacag

SEQ ID NO: 1305 - DNA, 41 bp, Artificial Sequence
  CFor_81_CCTTGT-T_ov
  modified_base 1: /mod_base="OTHER" /note="5'-phosphorylation"
tccttgtgtctcgtgggctcggagatgtgtataagagacag

SEQ ID NO: 1306 - DNA, 41 bp, Artificial Sequence
  CFor_82_TCTGCT-T_ov
  modified_base 1: /mod_base="OTHER" /note="5'-phosphorylation"
ttctgctgtctcgtgggctcggagatgtgtataagagacag

SEQ ID NO: 1307 - DNA, 41 bp, Artificial Sequence
  CFor_83_GTTGAC-T_ov
  modified_base 1: /mod_base="OTHER" /note="5'-phosphorylation"
tgttgacgtctcgtgggctcggagatgtgtataagagacag

SEQ ID NO: 1308 - DNA, 41 bp, Artificial Sequence
  CFor_84_CTTCAG-T_ov
  modified_base 1: /mod_base="OTHER" /note="5'-phosphorylation"
tcttcaggtctcgtgggctcggagatgtgtataagagacag

SEQ ID NO: 1309 - DNA, 41 bp, Artificial Sequence
  CFor_85_TCGTAC-T_ov
  modified_base 1: /mod_base="OTHER" /note="5'-phosphorylation"
ttcgtacgtctcgtgggctcggagatgtgtataagagacag

SEQ ID NO: 1310 - DNA, 41 bp, Artificial Sequence
  CFor_86_TTCGGA-T_ov
  modified_base 1: /mod_base="OTHER" /note="5'-phosphorylation"
tttcggagtctcgtgggctcggagatgtgtataagagacag

SEQ ID NO: 1311 - DNA, 41 bp, Artificial Sequence
  CFor_87_TTCCCA-T_ov
  modified_base 1: /mod_base="OTHER" /note="5'-phosphorylation"
tttcccagtctcgtgggctcggagatgtgtataagagacag

SEQ ID NO: 1312 - DNA, 41 bp, Artificial Sequence
  CFor_88_CTTGCA-T_ov
  modified_base 1: /mod_base="OTHER" /note="5'-phosphorylation"
tcttgcagtctcgtgggctcggagatgtgtataagagacag

SEQ ID NO: 1313 - DNA, 41 bp, Artificial Sequence
  CFor_89_CTTCCT-T_ov
  modified_base 1: /mod_base="OTHER" /note="5'-phosphorylation"
tcttcctgtctcgtgggctcggagatgtgtataagagacag

SEQ ID NO: 1314 - DNA, 41 bp, Artificial Sequence
  CFor_90_GTACCT-T_ov
  modified_base 1: /mod_base="OTHER" /note="5'-phosphorylation"
tgtacctgtctcgtgggctcggagatgtgtataagagacag

SEQ ID NO: 1315 - DNA, 41 bp, Artificial Sequence
  CFor_91_CAGAGT-T_ov
  modified_base 1: /mod_base="OTHER" /note="5'-phosphorylation"
tcagagtgtctcgtgggctcggagatgtgtataagagacag

SEQ ID NO: 1316 - DNA, 41 bp, Artificial Sequence
  CFor_92_TAGGAC-T_ov
  modified_base 1: /mod_base="OTHER" /note="5'-phosphorylation"
ttaggacgtctcgtgggctcggagatgtgtataagagacag

SEQ ID NO: 1317 - DNA, 41 bp, Artificial Sequence
  CFor_93_AGGCTT-T_ov
  modified_base 1: /mod_base="OTHER" /note="5'-phosphorylation"
taggcttgtctcgtgggctcggagatgtgtataagagacag

SEQ ID NO: 1318 - DNA, 41 bp, Artificial Sequence
  CFor_94_TGGCTA-T_ov
  modified_base 1: /mod_base="OTHER" /note="5'-phosphorylation"
ttggctagtctcgtgggctcggagatgtgtataagagacag

SEQ ID NO: 1319 - DNA, 41 bp, Artificial Sequence
  CFor_95_ACGGTT-T_ov
  modified_base 1: /mod_base="OTHER" /note="5'-phosphorylation"
tacggttgtctcgtgggctcggagatgtgtataagagacag

SEQ ID NO: 1320 - DNA, 41 bp, Artificial Sequence
  CFor_96_TTGGCA-T_ov
  modified_base 1: /mod_base="OTHER" /note="5'-phosphorylation"
tttggcagtctcgtgggctcggagatgtgtataagagacag

SEQ ID NO: 1321 - DNA, 41 bp, Artificial Sequence
  CFor_1_CGTTTC-G_ov
  modified_base 1: /mod_base="OTHER" /note="5'-phosphorylation"
gcgtttcgtctcgtgggctcggagatgtgtataagagacag

SEQ ID NO: 1322 - DNA, 41 bp, Artificial Sequence
  CFor_2_TGGTGT-G_ov
  modified_base 1: /mod_base="OTHER" /note="5'-phosphorylation"
gtggtgtgtctcgtgggctcggagatgtgtataagagacag

SEQ ID NO: 1323 - DNA, 41 bp, Artificial Sequence
  CFor_3_TCTCGA-G_ov
  modified_base 1: /mod_base="OTHER" /note="5'-phosphorylation"
gtctcgagtctcgtgggctcggagatgtgtataagagacag

SEQ ID NO: 1324 - DNA, 41 bp, Artificial Sequence
  CFor_4_GAAGGA-G_ov
  modified_base 1: /mod_base="OTHER" /note="5'-phosphorylation"
ggaaggagtctcgtgggctcggagatgtgtataagagacag

SEQ ID NO: 1325 - DNA, 41 bp, Artificial Sequence
  CFor_5_GAACAG-G_ov
  modified_base 1: /mod_base="OTHER" /note="5'-phosphorylation"
ggaacaggtctcgtgggctcggagatgtgtataagagacag

SEQ ID NO: 1326 - DNA, 41 bp, Artificial Sequence
  CFor_6_GAAACC-G_ov
  modified_base 1: /mod_base="OTHER" /note="5'-phosphorylation"
ggaaaccgtctcgtgggctcggagatgtgtataagagacag

SEQ ID NO: 1327 - DNA, 41 bp, Artificial Sequence
  CFor_7_CAACCA-G_ov
  modified_base 1: /mod_base="OTHER" /note="5'-phosphorylation"
gcaaccagtctcgtgggctcggagatgtgtataagagacag

SEQ ID NO: 1328 - DNA, 41 bp, Artificial Sequence
  CFor_8_CAAAGG-G_ov
  modified_base 1: /mod_base="OTHER" /note="5'-phosphorylation"
gcaaagggtctcgtgggctcggagatgtgtataagagacag

SEQ ID NO: 1329 - DNA, 41 bp, Artificial Sequence
  CFor_9_CAAGAC-G_ov
  modified_base 1: /mod_base="OTHER" /note="5'-phosphorylation"
gcaagacgtctcgtgggctcggagatgtgtataagagacag

SEQ ID NO: 1330 - DNA, 41 bp, Artificial Sequence
  CFor_10_TAAGCG-G_ov
  modified_base 1: /mod_base="OTHER" /note="5'-phosphorylation"
gtaagcggtctcgtgggctcggagatgtgtataagagacag

SEQ ID NO: 1331 - DNA, 41 bp, Artificial Sequence
  CFor_11_TAACGC-G_ov
  modified_base 1: /mod_base="OTHER" /note="5'-phosphorylation"
gtaacgcgtctcgtgggctcggagatgtgtataagagacag

SEQ ID NO: 1332 - DNA, 41 bp, Artificial Sequence
  CFor_12_AGACGA-G_ov
  modified_base 1: /mod_base="OTHER" /note="5'-phosphorylation"
gagacgagtctcgtgggctcggagatgtgtataagagacag

SEQ ID NO: 1333 - DNA, 41 bp, Artificial Sequence
  CFor_13_AGAGAG-G_ov
  modified_base 1: /mod_base="OTHER" /note="5'-phosphorylation"
gagagaggtctcgtgggctcggagatgtgtataagagacag

SEQ ID NO: 1334 - DNA, 41 bp, Artificial Sequence
  CFor_14_AGATCC-G_ov
  modified_base 1: /mod_base="OTHER" /note="5'-phosphorylation"
gagatccgtctcgtgggctcggagatgtgtataagagacag

SEQ ID NO: 1335 - DNA, 41 bp, Artificial Sequence
  CFor_15_GGAAGT-G_ov
  modified_base 1: /mod_base="OTHER" /note="5'-phosphorylation"
gggaagtgtctcgtgggctcggagatgtgtataagagacag

SEQ ID NO: 1336 - DNA, 41 bp, Artificial Sequence
  CFor_16_CGAGTA-G_ov
  modified_base 1: /mod_base="OTHER" /note="5'-phosphorylation"
gcgagtagtctcgtgggctcggagatgtgtataagagacag

SEQ ID NO: 1337 - DNA, 41 bp, Artificial Sequence
  CFor_17_CGACAT-G_ov
  modified_base 1: /mod_base="OTHER" /note="5'-phosphorylation"
gcgacatgtctcgtgggctcggagatgtgtataagagacag

SEQ ID NO: 1338 - DNA, 41 bp, Artificial Sequence
  CFor_18_TGACTG-G_ov
  modified_base 1: /mod_base="OTHER" /note="5'-phosphorylation"
gtgactggtctcgtgggctcggagatgtgtataagagacag

SEQ ID NO: 1339 - DNA, 41 bp, Artificial Sequence
  CFor_19_ACAGCA-G_ov
  modified_base 1: /mod_base="OTHER" /note="5'-phosphorylation"
gacagcagtctcgtgggctcggagatgtgtataagagacag

SEQ ID NO: 1340 - DNA, 41 bp, Artificial Sequence
  CFor_20_ACATGG-G_ov
  modified_base 1: /mod_base="OTHER" /note="5'-phosphorylation"
gacatgggtctcgtgggctcggagatgtgtataagagacag

SEQ ID NO: 1341 - DNA, 41 bp, Artificial Sequence
  CFor_21_ACACAC-G_ov
  modified_base 1: /mod_base="OTHER" /note="5'-phosphorylation"
gacacacgtctcgtgggctcggagatgtgtataagagacag

SEQ ID NO: 1342 - DNA, 41 bp, Artificial Sequence
  CFor_22_GCACTA-G_ov
  modified_base 1: /mod_base="OTHER" /note="5'-phosphorylation"
ggcactagtctcgtgggctcggagatgtgtataagagacag

SEQ ID NO: 1343 - DNA, 41 bp, Artificial Sequence
  CFor_23_GCAGAT-G_ov
  modified_base 1: /mod_base="OTHER" /note="5'-phosphorylation"
ggcagatgtctcgtgggctcggagatgtgtataagagacag

SEQ ID NO: 1344 - DNA, 41 bp, Artificial Sequence
  CFor_24_CCAACT-G_ov
  modified_base 1: /mod_base="OTHER" /note="5'-phosphorylation"
gccaactgtctcgtgggctcggagatgtgtataagagacag

SEQ ID NO: 1345 - DNA, 41 bp, Artificial Sequence
  CFor_25_TCAGTC-G_ov
  modified_base 1: /mod_base="OTHER" /note="5'-phosphorylation"
gtcagtcgtctcgtgggctcggagatgtgtataagagacag

SEQ ID NO: 1346 - DNA, 41 bp, Artificial Sequence
  CFor_26_ATACCG-G_ov
  modified_base 1: /mod_base="OTHER" /note="5'-phosphorylation"
gataccggtctcgtgggctcggagatgtgtataagagacag

SEQ ID NO: 1347 - DNA, 41 bp, Artificial Sequence
  CFor_27_ATAGGC-G_ov
  modified_base 1: /mod_base="OTHER" /note="5'-phosphorylation"
gataggcgtctcgtgggctcggagatgtgtataagagacag

SEQ ID NO: 1348 - DNA, 41 bp, Artificial Sequence
  CFor_28_GTAGTG-G_ov
  modified_base 1: /mod_base="OTHER" /note="5'-phosphorylation"
ggtagtggtctcgtgggctcggagatgtgtataagagacag

SEQ ID NO: 1349 - DNA, 41 bp, Artificial Sequence
  CFor_29_CTACTC-G_ov
  modified_base 1: /mod_base="OTHER" /note="5'-phosphorylation"
gctactcgtctcgtgggctcggagatgtgtataagagacag

SEQ ID NO: 1350 - DNA, 41 bp, Artificial Sequence
  CFor_30_AAGACG-G_ov
  modified_base 1: /mod_base="OTHER" /note="5'-phosphorylation"
gaagacggtctcgtgggctcggagatgtgtataagagacag

SEQ ID NO: 1351 - DNA, 41 bp, Artificial Sequence
  CFor_31_AAGTGC-G_ov
  modified_base 1: /mod_base="OTHER" /note="5'-phosphorylation"
gaagtgcgtctcgtgggctcggagatgtgtataagagacag

SEQ ID NO: 1352 - DNA, 41 bp, Artificial Sequence
  CFor_32_GAGTCA-G_ov
  modified_base 1: /mod_base="OTHER" /note="5'-phosphorylation"
ggagtcagtctcgtgggctcggagatgtgtataagagacag

SEQ ID NO: 1353 - DNA, 41 bp, Artificial Sequence
  CFor_33_GAGGTT-G_ov
  modified_base 1: /mod_base="OTHER" /note="5'-phosphorylation"
ggaggttgtctcgtgggctcggagatgtgtataagagacag

SEQ ID NO: 1354 - DNA, 41 bp, Artificial Sequence
  CFor_34_CAGTAG-G_ov
  modified_base 1: /mod_base="OTHER" /note="5'-phosphorylation"
gcagtaggtctcgtgggctcggagatgtgtataagagacag

SEQ ID NO: 1355 - DNA, 41 bp, Artificial Sequence
  CFor_35_CAGATC-G_ov
  modified_base 1: /mod_base="OTHER" /note="5'-phosphorylation"
gcagatcgtctcgtgggctcggagatgtgtataagagacag

SEQ ID NO: 1356 - DNA, 41 bp, Artificial Sequence
  CFor_36_TAGCCT-G_ov
  modified_base 1: /mod_base="OTHER" /note="5'-phosphorylation"
gtagcctgtctcgtgggctcggagatgtgtataagagacag

SEQ ID NO: 1357 - DNA, 41 bp, Artificial Sequence
  CFor_37_AGGTTG-G_ov
  modified_base 1: /mod_base="OTHER" /note="5'-phosphorylation"
gaggttggtctcgtgggctcggagatgtgtataagagacag

SEQ ID NO: 1358 - DNA, 41 bp, Artificial Sequence
  CFor_38_AGGAAC-G_ov
  modified_base 1: /mod_base="OTHER" /note="5'-phosphorylation"
gaggaacgtctcgtgggctcggagatgtgtataagagacag

SEQ ID NO: 1359 - DNA, 41 bp, Artificial Sequence
  CFor_39_TGGGAA-G_ov
  modified_base 1: /mod_base="OTHER" /note="5'-phosphorylation"
gtgggaagtctcgtgggctcggagatgtgtataagagacag

SEQ ID NO: 1360 - DNA, 41 bp, Artificial Sequence
  CFor_40_ACGAGA-G_ov
  modified_base 1: /mod_base="OTHER" /note="5'-phosphorylation"
gacgagagtctcgtgggctcggagatgtgtataagagacag

SEQ ID NO: 1361 - DNA, 41 bp, Artificial Sequence
  CFor_41_ACGTCT-G_ov
  modified_base 1: /mod_base="OTHER" /note="5'-phosphorylation"
gacgtctgtctcgtgggctcggagatgtgtataagagacag

SEQ ID NO: 1362 - DNA, 41 bp, Artificial Sequence
  CFor_42_CCGTTA-G_ov
  modified_base 1: /mod_base="OTHER" /note="5'-phosphorylation"
gccgttagtctcgtgggctcggagatgtgtataagagacag

SEQ ID NO: 1363 - DNA, 41 bp, Artificial Sequence
  CFor_43_TCGAAG-G_ov
  modified_base 1: /mod_base="OTHER" /note="5'-phosphorylation"
gtcgaaggtctcgtgggctcggagatgtgtataagagacag

SEQ ID NO: 1364 - DNA, 41 bp, Artificial Sequence
  CFor_44_ATGCGT-G_ov
  modified_base 1: /mod_base="OTHER" /note="5'-phosphorylation"
gatgcgtgtctcgtgggctcggagatgtgtataagagacag

SEQ ID NO: 1365 - DNA, 41 bp, Artificial Sequence
  CFor_45_GTGCAA-G_ov
  modified_base 1: /mod_base="OTHER" /note="5'-phosphorylation"
ggtgcaagtctcgtgggctcggagatgtgtataagagacag

SEQ ID NO: 1366 - DNA, 41 bp, Artificial Sequence
  CFor_46_GTGTTC-G_ov
  modified_base 1: /mod_base="OTHER" /note="5'-phosphorylation"
ggtgttcgtctcgtgggctcggagatgtgtataagagacag

SEQ ID NO: 1367 - DNA, 41 bp, Artificial Sequence
  CFor_47_GTGACT-G_ov
  modified_base 1: /mod_base="OTHER" /note="5'-phosphorylation"
ggtgactgtctcgtgggctcggagatgtgtataagagacag

SEQ ID NO: 1368 - DNA, 41 bp, Artificial Sequence
  CFor_48_CTGGAT-G_ov
  modified_base 1: /mod_base="OTHER" /note="5'-phosphorylation"
gctggatgtctcgtgggctcggagatgtgtataagagacag

SEQ ID NO: 1369 - DNA, 41 bp, Artificial Sequence
  CFor_49_TTGTCG-G_ov
  modified_base 1: /mod_base="OTHER" /note="5'-phosphorylation"
gttgtcggtctcgtgggctcggagatgtgtataagagacag

SEQ ID NO: 1370 - DNA, 41 bp, Artificial Sequence
  CFor_50_TTGAGC-G_ov
  modified_base 1: /mod_base="OTHER" /note="5'-phosphorylation"
gttgagcgtctcgtgggctcggagatgtgtataagagacag

SEQ ID NO: 1371 - DNA, 41 bp, Artificial Sequence
  CFor_51_AACGTG-G_ov
  modified_base 1: /mod_base="OTHER" /note="5'-phosphorylation"
gaacgtggtctcgtgggctcggagatgtgtataagagacag

SEQ ID NO: 1372 - DNA, 41 bp, Artificial Sequence
  CFor_52_GACTAC-G_ov
  modified_base 1: /mod_base="OTHER" /note="5'-phosphorylation"
ggactacgtctcgtgggctcggagatgtgtataagagacag

SEQ ID NO: 1373 - DNA, 41 bp, Artificial Sequence
  CFor_53_CACTGA-G_ov
  modified_base 1: /mod_base="OTHER" /note="5'-phosphorylation"
gcactgagtctcgtgggctcggagatgtgtataagagacag

SEQ ID NO: 1374 - DNA, 41 bp, Artificial Sequence
  CFor_54_CACCTT-G_ov
  modified_base 1: /mod_base="OTHER" /note="5'-phosphorylation"
gcaccttgtctcgtgggctcggagatgtgtataagagacag

SEQ ID NO: 1375 - DNA, 41 bp, Artificial Sequence
  CFor_55_TACGGT-G_ov
  modified_base 1: /mod_base="OTHER" /note="5'-phosphorylation"
gtacggtgtctcgtgggctcggagatgtgtataagagacag

SEQ ID NO: 1376 - DNA, 41 bp, Artificial Sequence
  CFor_56_AGCACA-G_ov
  modified_base 1: /mod_base="OTHER" /note="5'-phosphorylation"
gagcacagtctcgtgggctcggagatgtgtataagagacag

SEQ ID NO: 1377 - DNA, 41 bp, Artificial Sequence
  CFor_57_GGCTTA-G_ov
  modified_base 1: /mod_base="OTHER" /note="5'-phosphorylation"
gggcttagtctcgtgggctcggagatgtgtataagagacag

SEQ ID NO: 1378 - DNA, 41 bp, Artificial Sequence
  CFor_58_TGCTAG-G_ov
  modified_base 1: /mod_base="OTHER" /note="5'-phosphorylation"
gtgctaggtctcgtgggctcggagatgtgtataagagacag

SEQ ID NO: 1379 - DNA, 41 bp, Artificial Sequence
  CFor_59_TGCATC-G_ov
  modified_base 1: /mod_base="OTHER" /note="5'-phosphorylation"
gtgcatcgtctcgtgggctcggagatgtgtataagagacag

SEQ ID NO: 1380 - DNA, 41 bp, Artificial Sequence
  CFor_60_ACCTTC-G_ov
  modified_base 1: /mod_base="OTHER" /note="5'-phosphorylation"
gaccttcgtctcgtgggctcggagatgtgtataagagacag

SEQ ID NO: 1381 - DNA, 41 bp, Artificial Sequence
  CFor_61_GCCATT-G_ov
  modified_base 1: /mod_base="OTHER" /note="5'-phosphorylation"
ggccattgtctcgtgggctcggagatgtgtataagagacag

SEQ ID NO: 1382 - DNA, 41 bp, Artificial Sequence
  CFor_62_TCCTCA-G_ov
  modified_base 1: /mod_base="OTHER" /note="5'-phosphorylation"
gtcctcagtctcgtgggctcggagatgtgtataagagacag

SEQ ID NO: 1383 - DNA, 41 bp, Artificial Sequence
  CFor_63_TCCCAT-G_ov
  modified_base 1: /mod_base="OTHER" /note="5'-phosphorylation"
gtcccatgtctcgtgggctcggagatgtgtataagagacag

SEQ ID NO: 1384 - DNA, 41 bp, Artificial Sequence
  CFor_64_ATCAGG-G_ov
  modified_base 1: /mod_base="OTHER" /note="5'-phosphorylation"
gatcagggtctcgtgggctcggagatgtgtataagagacag

SEQ ID NO: 1385 - DNA, 41 bp, Artificial Sequence
  CFor_65_ATCGCT-G_ov
  modified_base 1: /mod_base="OTHER" /note="5'-phosphorylation"
gatcgctgtctcgtgggctcggagatgtgtataagagacag

SEQ ID NO: 1386 - DNA, 41 bp, Artificial Sequence
  CFor_66_GTCTGT-G_ov
  modified_base 1: /mod_base="OTHER" /note="5'-phosphorylation"
ggtctgtgtctcgtgggctcggagatgtgtataagagacag

SEQ ID NO: 1387 - DNA, 41 bp, Artificial Sequence
  CFor_67_CTCTTG-G_ov
  modified_base 1: /mod_base="OTHER" /note="5'-phosphorylation"
gctcttggtctcgtgggctcggagatgtgtataagagacag

SEQ ID NO: 1388 - DNA, 41 bp, Artificial Sequence
  CFor_68_CTCAAC-G_ov
  modified_base 1: /mod_base="OTHER" /note="5'-phosphorylation"
gctcaacgtctcgtgggctcggagatgtgtataagagacag

SEQ ID NO: 1389 - DNA, 41 bp, Artificial Sequence
  CFor_69_AATCGG-G_ov
  modified_base 1: /mod_base="OTHER" /note="5'-phosphorylation"
gaatcgggtctcgtgggctcggagatgtgtataagagacag

SEQ ID NO: 1390 - DNA, 41 bp, Artificial Sequence
  CFor_70_AATGCC-G_ov
  modified_base 1: /mod_base="OTHER" /note="5'-phosphorylation"
gaatgccgtctcgtgggctcggagatgtgtataagagacag

SEQ ID NO: 1391 - DNA, 41 bp, Artificial Sequence
  CFor_71_GATCTC-G_ov
  modified_base 1: /mod_base="OTHER" /note="5'-phosphorylation"
ggatctcgtctcgtgggctcggagatgtgtataagagacag

SEQ ID NO: 1392 - DNA, 41 bp, Artificial Sequence
  CFor_72_AGTGGT-G_ov
  modified_base 1: /mod_base="OTHER" /note="5'-phosphorylation"
gagtggtgtctcgtgggctcggagatgtgtataagagacag

SEQ ID NO: 1393 - DNA, 41 bp, Artificial Sequence
  CFor_73_GGTTCT-G_ov
  modified_base 1: /mod_base="OTHER" /note="5'-phosphorylation"
gggttctgtctcgtgggctcggagatgtgtataagagacag

SEQ ID NO: 1394 - DNA, 41 bp, Artificial Sequence
  CFor_74_CGTAGA-G_ov
  modified_base 1: /mod_base="OTHER" /note="5'-phosphorylation"
gcgtagagtctcgtgggctcggagatgtgtataagagacag

SEQ ID NO: 1395 - DNA, 41 bp, Artificial Sequence
  CFor_75_TGTACG-G_ov
  modified_base 1: /mod_base="OTHER" /note="5'-phosphorylation"
gtgtacggtctcgtgggctcggagatgtgtataagagacag

SEQ ID NO: 1396 - DNA, 41 bp, Artificial Sequence
  CFor_76_TGTCAC-G_ov
  modified_base 1: /mod_base="OTHER" /note="5'-phosphorylation"
gtgtcacgtctcgtgggctcggagatgtgtataagagacag

SEQ ID NO: 1397 - DNA, 41 bp, Artificial Sequence
  CFor_77_GCTACA-G_ov
  modified_base 1: /mod_base="OTHER" /note="5'-phosphorylation"
ggctacagtctcgtgggctcggagatgtgtataagagacag

SEQ ID NO: 1398 - DNA, 41 bp, Artificial Sequence
  CFor_78_GCTTAG-G_ov
  modified_base 1: /mod_base="OTHER" /note="5'-phosphorylation"
ggcttaggtctcgtgggctcggagatgtgtataagagacag

SEQ ID NO: 1399 - DNA, 41 bp, Artificial Sequence
  CFor_79_CCTGAA-G_ov
  modified_base 1: /mod_base="OTHER" /note="5'-phosphorylation"
gcctgaagtctcgtgggctcggagatgtgtataagagacag

SEQ ID NO: 1400 - DNA, 41 bp, Artificial Sequence
  CFor_80_CCTATG-G_ov
  modified_base 1: /mod_base="OTHER" /note="5'-phosphorylation"
gcctatggtctcgtgggctcggagatgtgtataagagacag

SEQ ID NO: 1401 - DNA, 41 bp, Artificial Sequence
  CFor_81_CCTTGT-G_ov
  modified_base 1: /mod_base="OTHER" /note="5'-phosphorylation"
gccttgtgtctcgtgggctcggagatgtgtataagagacag

SEQ ID NO: 1402 - DNA, 41 bp, Artificial Sequence
  CFor_82_TCTGCT-G_ov
  modified_base 1: /mod_base="OTHER" /note="5'-phosphorylation"
gtctgctgtctcgtgggctcggagatgtgtataagagacag

SEQ ID NO: 1403 - DNA, 41 bp, Artificial Sequence
  CFor_83_GTTGAC-G_ov
  modified_base 1: /mod_base="OTHER" /note="5'-phosphorylation"
ggttgacgtctcgtgggctcggagatgtgtataagagacag

SEQ ID NO: 1404 - DNA, 41 bp, Artificial Sequence
  CFor_84_CTTCAG-G_ov
  modified_base 1: /mod_base="OTHER" /note="5'-phosphorylation"
gcttcaggtctcgtgggctcggagatgtgtataagagacag

SEQ ID NO: 1405 - DNA, 41 bp, Artificial Sequence
  CFor_85_TCGTAC-G_ov
  modified_base 1: /mod_base="OTHER" /note="5'-phosphorylation"
gtcgtacgtctcgtgggctcggagatgtgtataagagacag

SEQ ID NO: 1406 - DNA, 41 bp, Artificial Sequence
  CFor_86_TTCGGA-G_ov
  modified_base 1: /mod_base="OTHER" /note="5'-phosphorylation"
gttcggagtctcgtgggctcggagatgtgtataagagacag

SEQ ID NO: 1407 - DNA, 41 bp, Artificial Sequence
  CFor_87_TTCCCA-G_ov
  modified_base 1: /mod_base="OTHER" /note="5'-phosphorylation"
gttcccagtctcgtgggctcggagatgtgtataagagacag

SEQ ID NO: 1408 - DNA, 41 bp, Artificial Sequence
  CFor_88_CTTGCA-G_ov
  modified_base 1: /mod_base="OTHER" /note="5'-phosphorylation"
gcttgcagtctcgtgggctcggagatgtgtataagagacag

SEQ ID NO: 1409 - DNA, 41 bp, Artificial Sequence
  CFor_89_CTTCCT-G_ov
  modified_base 1: /mod_base="OTHER" /note="5'-phosphorylation"
gcttcctgtctcgtgggctcggagatgtgtataagagacag

SEQ ID NO: 1410 - DNA, 41 bp, Artificial Sequence
  CFor_90_GTACCT-G_ov
  modified_base 1: /mod_base="OTHER" /note="5'-phosphorylation"
ggtacctgtctcgtgggctcggagatgtgtataagagacag

SEQ ID NO: 1411 - DNA, 41 bp, Artificial Sequence
  CFor_91_CAGAGT-G_ov
  modified_base 1: /mod_base="OTHER" /note="5'-phosphorylation"
gcagagtgtctcgtgggctcggagatgtgtataagagacag

SEQ ID NO: 1412 - DNA, 41 bp, Artificial Sequence
  CFor_92_TAGGAC-G_ov
  modified_base 1: /mod_base="OTHER" /note="5'-phosphorylation"
gtaggacgtctcgtgggctcggagatgtgtataagagacag

SEQ ID NO: 1413 - DNA, 41 bp, Artificial Sequence
  CFor_93_AGGCTT-G_ov
  modified_base 1: /mod_base="OTHER" /note="5'-phosphorylation"
gaggcttgtctcgtgggctcggagatgtgtataagagacag

SEQ ID NO: 1414 - DNA, 41 bp, Artificial Sequence
  CFor_94_TGGCTA-G_ov
  modified_base 1: /mod_base="OTHER" /note="5'-phosphorylation"
gtggctagtctcgtgggctcggagatgtgtataagagacag

SEQ ID NO: 1415 - DNA, 41 bp, Artificial Sequence
  CFor_95_ACGGTT-G_ov
  modified_base 1: /mod_base="OTHER" /note="5'-phosphorylation"
gacggttgtctcgtgggctcggagatgtgtataagagacag

SEQ ID NO: 1416 - DNA, 41 bp, Artificial Sequence
  CFor_96_TTGGCA-G_ov
  modified_base 1: /mod_base="OTHER" /note="5'-phosphorylation"
gttggcagtctcgtgggctcggagatgtgtataagagacag

SEQ ID NO: 1417 - DNA, 41 bp, Artificial Sequence
  CFor_1_CGTTTC-A_ov
  modified_base 1: /mod_base="OTHER" /note="5'-phosphorylation"
acgtttcgtctcgtgggctcggagatgtgtataagagacag

SEQ ID NO: 1418 - DNA, 41 bp, Artificial Sequence
  CFor_2_TGGTGT-A_ov
  modified_base 1: /mod_base="OTHER" /note="5'-phosphorylation"
atggtgtgtctcgtgggctcggagatgtgtataagagacag

SEQ ID NO: 1419 - DNA, 41 bp, Artificial Sequence
  CFor_3_TCTCGA-A_ov
  modified_base 1: /mod_base="OTHER" /note="5'-phosphorylation"
atctcgagtctcgtgggctcggagatgtgtataagagacag

SEQ ID NO: 1420 - DNA, 41 bp, Artificial Sequence
  CFor_4_GAAGGA-A_ov
  modified_base 1: /mod_base="OTHER" /note="5'-phosphorylation"
agaaggagtctcgtgggctcggagatgtgtataagagacag

SEQ ID NO: 1421 - DNA, 41 bp, Artificial Sequence
  CFor_5_GAACAG-A_ov
  modified_base 1: /mod_base="OTHER" /note="5'-phosphorylation"
agaacaggtctcgtgggctcggagatgtgtataagagacag

SEQ ID NO: 1422 - DNA, 41 bp, Artificial Sequence
  CFor_6_GAAACC-A_ov
  modified_base 1: /mod_base="OTHER" /note="5'-phosphorylation"
agaaaccgtctcgtgggctcggagatgtgtataagagacag

SEQ ID NO: 1423 - DNA, 41 bp, Artificial Sequence
  CFor_7_CAACCA-A_ov
  modified_base 1: /mod_base="OTHER" /note="5'-phosphorylation"
acaaccagtctcgtgggctcggagatgtgtataagagacag

SEQ ID NO: 1424 - DNA, 41 bp, Artificial Sequence
  CFor_8_CAAAGG-A_ov
  modified_base 1: /mod_base="OTHER" /note="5'-phosphorylation"
acaaagggtctcgtgggctcggagatgtgtataagagacag

SEQ ID NO: 1425 - DNA, 41 bp, Artificial Sequence
  CFor_9_CAAGAC-A_ov
  modified_base 1: /mod_base="OTHER" /note="5'-phosphorylation"
acaagacgtctcgtgggctcggagatgtgtataagagacag

SEQ ID NO: 1426 - DNA, 41 bp, Artificial Sequence
  CFor_10_TAAGCG-A_ov
  modified_base 1: /mod_base="OTHER" /note="5'-phosphorylation"
ataagcggtctcgtgggctcggagatgtgtataagagacag

SEQ ID NO: 1427 - DNA, 41 bp, Artificial Sequence
  CFor_11_TAACGC-A_ov
  modified_base 1: /mod_base="OTHER" /note="5'-phosphorylation"
ataacgcgtctcgtgggctcggagatgtgtataagagacag

SEQ ID NO: 1428 - DNA, 41 bp, Artificial Sequence
  CFor_12_AGACGA-A_ov
  modified_base 1: /mod_base="OTHER" /note="5'-phosphorylation"
aagacgagtctcgtgggctcggagatgtgtataagagacag

SEQ ID NO: 1429 - DNA, 41 bp, Artificial Sequence
  CFor_13_AGAGAG-A_ov
  modified_base 1: /mod_base="OTHER" /note="5'-phosphorylation"
aagagaggtctcgtgggctcggagatgtgtataagagacag

SEQ ID NO: 1430 - DNA, 41 bp, Artificial Sequence
  CFor_14_AGATCC-A_ov
  modified_base 1: /mod_base="OTHER" /note="5'-phosphorylation"
aagatccgtctcgtgggctcggagatgtgtataagagacag

SEQ ID NO: 1431 - DNA, 41 bp, Artificial Sequence
  CFor_15_GGAAGT-A_ov
  modified_base 1: /mod_base="OTHER" /note="5'-phosphorylation"
aggaagtgtctcgtgggctcggagatgtgtataagagacag

SEQ ID NO: 1432 - DNA, 41 bp, Artificial Sequence
  CFor_16_CGAGTA-A_ov
  modified_base 1: /mod_base="OTHER" /note="5'-phosphorylation"
acgagtagtctcgtgggctcggagatgtgtataagagacag

SEQ ID NO: 1433 - DNA, 41 bp, Artificial Sequence
  CFor_17_CGACAT-A_ov
  modified_base 1: /mod_base="OTHER" /note="5'-phosphorylation"
acgacatgtctcgtgggctcggagatgtgtataagagacag

SEQ ID NO: 1434 - DNA, 41 bp, Artificial Sequence
  CFor_18_TGACTG-A_ov
  modified_base 1: /mod_base="OTHER" /note="5'-phosphorylation"
atgactggtctcgtgggctcggagatgtgtataagagacag

SEQ ID NO: 1435 - DNA, 41 bp, Artificial Sequence
  CFor_19_ACAGCA-A_ov
  modified_base 1: /mod_base="OTHER" /note="5'-phosphorylation"
aacagcagtctcgtgggctcggagatgtgtataagagacag

SEQ ID NO: 1436 - DNA, 41 bp, Artificial Sequence
  CFor_20_ACATGG-A_ov
  modified_base 1: /mod_base="OTHER" /note="5'-phosphorylation"
aacatgggtctcgtgggctcggagatgtgtataagagacag

SEQ ID NO: 1437 - DNA, 41 bp, Artificial Sequence
  CFor_21_ACACAC-A_ov
  modified_base 1: /mod_base="OTHER" /note="5'-phosphorylation"
aacacacgtctcgtgggctcggagatgtgtataagagacag

SEQ ID NO: 1438 - DNA, 41 bp, Artificial Sequence
  CFor_22_GCACTA-A_ov
  modified_base 1: /mod_base="OTHER" /note="5'-phosphorylation"
agcactagtctcgtgggctcggagatgtgtataagagacag

SEQ ID NO: 1439 - DNA, 41 bp, Artificial Sequence
  CFor_23_GCAGAT-A_ov
  modified_base 1: /mod_base="OTHER" /note="5'-phosphorylation"
agcagatgtctcgtgggctcggagatgtgtataagagacag

SEQ ID NO: 1440 - DNA, 41 bp, Artificial Sequence
  CFor_24_CCAACT-A_ov
  modified_base 1: /mod_base="OTHER" /note="5'-phosphorylation"
accaactgtctcgtgggctcggagatgtgtataagagacag

SEQ ID NO: 1441 - DNA, 41 bp, Artificial Sequence
  CFor_25_TCAGTC-A_ov
  modified_base 1: /mod_base="OTHER" /note="5'-phosphorylation"
atcagtcgtctcgtgggctcggagatgtgtataagagacag

SEQ ID NO: 1442 - DNA, 41 bp, Artificial Sequence
  CFor_26_ATACCG-A_ov
  modified_base 1: /mod_base="OTHER" /note="5'-phosphorylation"
aataccggtctcgtgggctcggagatgtgtataagagacag

SEQ ID NO: 1443 - DNA, 41 bp, Artificial Sequence
  CFor_27_ATAGGC-A_ov
  modified_base 1: /mod_base="OTHER" /note="5'-phosphorylation"
aataggcgtctcgtgggctcggagatgtgtataagagacag

SEQ ID NO: 1444 - DNA, 41 bp, Artificial Sequence
  CFor_28_GTAGTG-A_ov
  modified_base 1: /mod_base="OTHER" /note="5'-phosphorylation"
agtagtggtctcgtgggctcggagatgtgtataagagacag

SEQ ID NO: 1445 - DNA, 41 bp, Artificial Sequence
  CFor_29_CTACTC-A_ov
  modified_base 1: /mod_base="OTHER" /note="5'-phosphorylation"
actactcgtctcgtgggctcggagatgtgtataagagacag

SEQ ID NO: 1446 - DNA, 41 bp, Artificial Sequence
  CFor_30_AAGACG-A_ov
  modified_base 1: /mod_base="OTHER" /note="5'-phosphorylation"
aaagacggtctcgtgggctcggagatgtgtataagagacag

SEQ ID NO: 1447 - DNA, 41 bp, Artificial Sequence
  CFor_31_AAGTGC-A_ov
  modified_base 1: /mod_base="OTHER" /note="5'-phosphorylation"
aaagtgcgtctcgtgggctcggagatgtgtataagagacag

SEQ ID NO: 1448 - DNA, 41 bp, Artificial Sequence
  CFor_32_GAGTCA-A_ov
  modified_base 1: /mod_base="OTHER" /note="5'-phosphorylation"
agagtcagtctcgtgggctcggagatgtgtataagagacag

SEQ ID NO: 1449 - DNA, 41 bp, Artificial Sequence
  CFor_33_GAGGTT-A_ov
  modified_base 1: /mod_base="OTHER" /note="5'-phosphorylation"
agaggttgtctcgtgggctcggagatgtgtataagagacag

SEQ ID NO: 1450 - DNA, 41 bp, Artificial Sequence
  CFor_34_CAGTAG-A_ov
  modified_base 1: /mod_base="OTHER" /note="5'-phosphorylation"
acagtaggtctcgtgggctcggagatgtgtataagagacag

SEQ ID NO: 1451 - DNA, 41 bp, Artificial Sequence
  CFor_35_CAGATC-A_ov
  modified_base 1: /mod_base="OTHER" /note="5'-phosphorylation"
acagatcgtctcgtgggctcggagatgtgtataagagacag

SEQ ID NO: 1452 - DNA, 41 bp, Artificial Sequence
  CFor_36_TAGCCT-A_ov
  modified_base 1: /mod_base="OTHER" /note="5'-phosphorylation"
atagcctgtctcgtgggctcggagatgtgtataagagacag

SEQ ID NO: 1453 - DNA, 41 bp, Artificial Sequence
  CFor_37_AGGTTG-A_ov
  modified_base 1: /mod_base="OTHER" /note="5'-phosphorylation"
aaggttggtctcgtgggctcggagatgtgtataagagacag

SEQ ID NO: 1454 - DNA, 41 bp, Artificial Sequence
  CFor_38_AGGAAC-A_ov
  modified_base 1: /mod_base="OTHER" /note="5'-phosphorylation"
aaggaacgtctcgtgggctcggagatgtgtataagagacag

SEQ ID NO: 1455 - DNA, 41 bp, Artificial Sequence
  CFor_39_TGGGAA-A_ov
  modified_base 1: /mod_base="OTHER" /note="5'-phosphorylation"
atgggaagtctcgtgggctcggagatgtgtataagagacag

SEQ ID NO: 1456 - DNA, 41 bp, Artificial Sequence
  CFor_40_ACGAGA-A_ov
  modified_base 1: /mod_base="OTHER" /note="5'-phosphorylation"
aacgagagtctcgtgggctcggagatgtgtataagagacag

SEQ ID NO: 1457 - DNA, 41 bp, Artificial Sequence
  CFor_41_ACGTCT-A_ov
  modified_base 1: /mod_base="OTHER" /note="5'-phosphorylation"
aacgtctgtctcgtgggctcggagatgtgtataagagacag

SEQ ID NO: 1458 - DNA, 41 bp, Artificial Sequence
  CFor_42_CCGTTA-A_ov
  modified_base 1: /mod_base="OTHER" /note="5'-phosphorylation"
accgttagtctcgtgggctcggagatgtgtataagagacag

SEQ ID NO: 1459 - DNA, 41 bp, Artificial Sequence
  CFor_43_TCGAAG-A_ov
  modified_base 1: /mod_base="OTHER" /note="5'-phosphorylation"
atcgaaggtctcgtgggctcggagatgtgtataagagacag

SEQ ID NO: 1460 - DNA, 41 bp, Artificial Sequence
  CFor_44_ATGCGT-A_ov
  modified_base 1: /mod_base="OTHER" /note="5'-phosphorylation"
aatgcgtgtctcgtgggctcggagatgtgtataagagacag

SEQ ID NO: 1461 - DNA, 41 bp, Artificial Sequence
  CFor_45_GTGCAA-A_ov
  modified_base 1: /mod_base="OTHER" /note="5'-phosphorylation"
agtgcaagtctcgtgggctcggagatgtgtataagagacag

SEQ ID NO: 1462 - DNA, 41 bp, Artificial Sequence
  CFor_46_GTGTTC-A_ov
  modified_base 1: /mod_base="OTHER" /note="5'-phosphorylation"
agtgttcgtctcgtgggctcggagatgtgtataagagacag

SEQ ID NO: 1463 - DNA, 41 bp, Artificial Sequence
  CFor_47_GTGACT-A_ov
  modified_base 1: /mod_base="OTHER" /note="5'-phosphorylation"
agtgactgtctcgtgggctcggagatgtgtataagagacag

SEQ ID NO: 1464 - DNA, 41 bp, Artificial Sequence
  CFor_48_CTGGAT-A_ov
  modified_base 1: /mod_base="OTHER" /note="5'-phosphorylation"
actggatgtctcgtgggctcggagatgtgtataagagacag

SEQ ID NO: 1465 - DNA, 41 bp, Artificial Sequence
  CFor_49_TTGTCG-A_ov
  modified_base 1: /mod_base="OTHER" /note="5'-phosphorylation"
attgtcggtctcgtgggctcggagatgtgtataagagacag

SEQ ID NO: 1466 - DNA, 41 bp, Artificial Sequence
  CFor_50_TTGAGC-A_ov
  modified_base 1: /mod_base="OTHER" /note="5'-phosphorylation"
attgagcgtctcgtgggctcggagatgtgtataagagacag

SEQ ID NO: 1467 - DNA, 41 bp, Artificial Sequence
  CFor_51_AACGTG-A_ov
  modified_base 1: /mod_base="OTHER" /note="5'-phosphorylation"
aaacgtggtctcgtgggctcggagatgtgtataagagacag

SEQ ID NO: 1468 - DNA, 41 bp, Artificial Sequence
  CFor_52_GACTAC-A_ov
  modified_base 1: /mod_base="OTHER" /note="5'-phosphorylation"
agactacgtctcgtgggctcggagatgtgtataagagacag

SEQ ID NO: 1469 - DNA, 41 bp, Artificial Sequence
  CFor_53_CACTGA-A_ov
  modified_base 1: /mod_base="OTHER" /note="5'-phosphorylation"
acactgagtctcgtgggctcggagatgtgtataagagacag

SEQ ID NO: 1470 - DNA, 41 bp, Artificial Sequence
  CFor_54_CACCTT-A_ov
  modified_base 1: /mod_base="OTHER" /note="5'-phosphorylation"
acaccttgtctcgtgggctcggagatgtgtataagagacag

SEQ ID NO: 1471 - DNA, 41 bp, Artificial Sequence
  CFor_55_TACGGT-A_ov
  modified_base 1: /mod_base="OTHER" /note="5'-phosphorylation"
atacggtgtctcgtgggctcggagatgtgtataagagacag

SEQ ID NO: 1472 - DNA, 41 bp, Artificial Sequence
  CFor_56_AGCACA-A_ov
  modified_base 1: /mod_base="OTHER" /note="5'-phosphorylation"
aagcacagtctcgtgggctcggagatgtgtataagagacag

SEQ ID NO: 1473 - DNA, 41 bp, Artificial Sequence
  CFor_57_GGCTTA-A_ov
  modified_base 1: /mod_base="OTHER" /note="5'-phosphorylation"
aggcttagtctcgtgggctcggagatgtgtataagagacag

SEQ ID NO: 1474 - DNA, 41 bp, Artificial Sequence
  CFor_58_TGCTAG-A_ov
  modified_base 1: /mod_base="OTHER" /note="5'-phosphorylation"
atgctaggtctcgtgggctcggagatgtgtataagagacag

SEQ ID NO: 1475 - DNA, 41 bp, Artificial Sequence
  CFor_59_TGCATC-A_ov
  modified_base 1: /mod_base="OTHER" /note="5'-phosphorylation"
atgcatcgtctcgtgggctcggagatgtgtataagagacag

SEQ ID NO: 1476 - DNA, 41 bp, Artificial Sequence
  CFor_60_ACCTTC-A_ov
  modified_base 1: /mod_base="OTHER" /note="5'-phosphorylation"
aaccttcgtctcgtgggctcggagatgtgtataagagacag

SEQ ID NO: 1477 - DNA, 41 bp, Artificial Sequence
  CFor_61_GCCATT-A_ov
  modified_base 1: /mod_base="OTHER" /note="5'-phosphorylation"
agccattgtctcgtgggctcggagatgtgtataagagacag

SEQ ID NO: 1478 - DNA, 41 bp, Artificial Sequence
  CFor_62_TCCTCA-A_ov
  modified_base 1: /mod_base="OTHER" /note="5'-phosphorylation"
atcctcagtctcgtgggctcggagatgtgtataagagacag

SEQ ID NO: 1479 - DNA, 41 bp, Artificial Sequence
  CFor_63_TCCCAT-A_ov
  modified_base 1: /mod_base="OTHER" /note="5'-phosphorylation"
atcccatgtctcgtgggctcggagatgtgtataagagacag

SEQ ID NO: 1480 - DNA, 41 bp, Artificial Sequence
  CFor_64_ATCAGG-A_ov
  modified_base 1: /mod_base="OTHER" /note="5'-phosphorylation"
aatcagggtctcgtgggctcggagatgtgtataagagacag

SEQ ID NO: 1481 - DNA, 41 bp, Artificial Sequence
  CFor_65_ATCGCT-A_ov
  modified_base 1: /mod_base="OTHER" /note="5'-phosphorylation"
aatcgctgtctcgtgggctcggagatgtgtataagagacag

SEQ ID NO: 1482 - DNA, 41 bp, Artificial Sequence
  CFor_66_GTCTGT-A_ov
  modified_base 1: /mod_base="OTHER" /note="5'-phosphorylation"
agtctgtgtctcgtgggctcggagatgtgtataagagacag

SEQ ID NO: 1483 - DNA, 41 bp, Artificial Sequence
  CFor_67_CTCTTG-A_ov
  modified_base 1: /mod_base="OTHER" /note="5'-phosphorylation"
actcttggtctcgtgggctcggagatgtgtataagagacag

SEQ ID NO: 1484 - DNA, 41 bp, Artificial Sequence
  CFor_68_CTCAAC-A_ov
  modified_base 1: /mod_base="OTHER" /note="5'-phosphorylation"
actcaacgtctcgtgggctcggagatgtgtataagagacag

SEQ ID NO: 1485 - DNA, 41 bp, Artificial Sequence
  CFor_69_AATCGG-A_ov
  modified_base 1: /mod_base="OTHER" /note="5'-phosphorylation"
aaatcgggtctcgtgggctcggagatgtgtataagagacag

SEQ ID NO: 1486 - DNA, 41 bp, Artificial Sequence
  CFor_70_AATGCC-A_ov
  modified_base 1: /mod_base="OTHER" /note="5'-phosphorylation"
aaatgccgtctcgtgggctcggagatgtgtataagagacag

SEQ ID NO: 1487 - DNA, 41 bp, Artificial Sequence
  CFor_71_GATCTC-A_ov
  modified_base 1: /mod_base="OTHER" /note="5'-phosphorylation"
agatctcgtctcgtgggctcggagatgtgtataagagacag

SEQ ID NO: 1488 - DNA, 41 bp, Artificial Sequence
  CFor_72_AGTGGT-A_ov
  modified_base 1: /mod_base="OTHER" /note="5'-phosphorylation"
aagtggtgtctcgtgggctcggagatgtgtataagagacag

SEQ ID NO: 1489 - DNA, 41 bp, Artificial Sequence
  CFor_73_GGTTCT-A_ov
  modified_base 1: /mod_base="OTHER" /note="5'-phosphorylation"
aggttctgtctcgtgggctcggagatgtgtataagagacag

SEQ ID NO: 1490 - DNA, 41 bp, Artificial Sequence
  CFor_74_CGTAGA-A_ov
  modified_base 1: /mod_base="OTHER" /note="5'-phosphorylation"
acgtagagtctcgtgggctcggagatgtgtataagagacag

SEQ ID NO: 1491 - DNA, 41 bp, Artificial Sequence
  CFor_75_TGTACG-A_ov
  modified_base 1: /mod_base="OTHER" /note="5'-phosphorylation"
atgtacggtctcgtgggctcggagatgtgtataagagacag

SEQ ID NO: 1492 - DNA, 41 bp, Artificial Sequence
  CFor_76_TGTCAC-A_ov
  modified_base 1: /mod_base="OTHER" /note="5'-phosphorylation"
atgtcacgtctcgtgggctcggagatgtgtataagagacag

SEQ ID NO: 1493 - DNA, 41 bp, Artificial Sequence
  CFor_77_GCTACA-A_ov
  modified_base 1: /mod_base="OTHER" /note="5'-phosphorylation"
agctacagtctcgtgggctcggagatgtgtataagagacag

SEQ ID NO: 1494 - DNA, 41 bp, Artificial Sequence
  CFor_78_GCTTAG-A_ov
  modified_base 1: /mod_base="OTHER" /note="5'-phosphorylation"
agcttaggtctcgtgggctcggagatgtgtataagagacag

SEQ ID NO: 1495 - DNA, 41 bp, Artificial Sequence
  CFor_79_CCTGAA-A_ov
  modified_base 1: /mod_base="OTHER" /note="5'-phosphorylation"
acctgaagtctcgtgggctcggagatgtgtataagagacag

SEQ ID NO: 1496 - DNA, 41 bp, Artificial Sequence
  CFor_80_CCTATG-A_ov
  modified_base 1: /mod_base="OTHER" /note="5'-phosphorylation"
acctatggtctcgtgggctcggagatgtgtataagagacag

SEQ ID NO: 1497 - DNA, 41 bp, Artificial Sequence
  CFor_81_CCTTGT-A_ov
  modified_base 1: /mod_base="OTHER" /note="5'-phosphorylation"
accttgtgtctcgtgggctcggagatgtgtataagagacag

SEQ ID NO: 1498 - DNA, 41 bp, Artificial Sequence
  CFor_82_TCTGCT-A_ov
  modified_base 1: /mod_base="OTHER" /note="5'-phosphorylation"
atctgctgtctcgtgggctcggagatgtgtataagagacag

SEQ ID NO: 1499 - DNA, 41 bp, Artificial Sequence
  CFor_83_GTTGAC-A_ov
  modified_base 1: /mod_base="OTHER" /note="5'-phosphorylation"
agttgacgtctcgtgggctcggagatgtgtataagagacag

SEQ ID NO: 1500 - DNA, 41 bp, Artificial Sequence
  CFor_84_CTTCAG-A_ov
  modified_base 1: /mod_base="OTHER" /note="5'-phosphorylation"
acttcaggtctcgtgggctcggagatgtgtataagagacag

SEQ ID NO: 1501 - DNA, 41 bp, Artificial Sequence
  CFor_85_TCGTAC-A_ov
  modified_base 1: /mod_base="OTHER" /note="5'-phosphorylation"
atcgtacgtctcgtgggctcggagatgtgtataagagacag

SEQ ID NO: 1502 - DNA, 41 bp, Artificial Sequence
  CFor_86_TTCGGA-A_ov
  modified_base 1: /mod_base="OTHER" /note="5'-phosphorylation"
attcggagtctcgtgggctcggagatgtgtataagagacag

SEQ ID NO: 1503 - DNA, 41 bp, Artificial Sequence
  CFor_87_TTCCCA-A_ov
  modified_base 1: /mod_base="OTHER" /note="5'-phosphorylation"
attcccagtctcgtgggctcggagatgtgtataagagacag

SEQ ID NO: 1504 - DNA, 41 bp, Artificial Sequence
  CFor_88_CTTGCA-A_ov
  modified_base 1: /mod_base="OTHER" /note="5'-phosphorylation"
acttgcagtctcgtgggctcggagatgtgtataagagacag

SEQ ID NO: 1505 - DNA, 41 bp, Artificial Sequence
  CFor_89_CTTCCT-A_ov
  modified_base 1: /mod_base="OTHER" /note="5'-phosphorylation"
acttcctgtctcgtgggctcggagatgtgtataagagacag

SEQ ID NO: 1506 - DNA, 41 bp, Artificial Sequence
  CFor_90_GTACCT-A_ov
  modified_base 1: /mod_base="OTHER" /note="5'-phosphorylation"
agtacctgtctcgtgggctcggagatgtgtataagagacag

SEQ ID NO: 1507 - DNA, 41 bp, Artificial Sequence
  CFor_91_CAGAGT-A_ov
  modified_base 1: /mod_base="OTHER" /note="5'-phosphorylation"
acagagtgtctcgtgggctcggagatgtgtataagagacag

SEQ ID NO: 1508 - DNA, 41 bp, Artificial Sequence
  CFor_92_TAGGAC-A_ov
  modified_base 1: /mod_base="OTHER" /note="5'-phosphorylation"
ataggacgtctcgtgggctcggagatgtgtataagagacag

SEQ ID NO: 1509 - DNA, 41 bp, Artificial Sequence
  CFor_93_AGGCTT-A_ov
  modified_base 1: /mod_base="OTHER" /note="5'-phosphorylation"
aaggcttgtctcgtgggctcggagatgtgtataagagacag

SEQ ID NO: 1510 - DNA, 41 bp, Artificial Sequence
  CFor_94_TGGCTA-A_ov
  modified_base 1: /mod_base="OTHER" /note="5'-phosphorylation"
atggctagtctcgtgggctcggagatgtgtataagagacag

SEQ ID NO: 1511 - DNA, 41 bp, Artificial Sequence
  CFor_95_ACGGTT-A_ov
  modified_base 1: /mod_base="OTHER" /note="5'-phosphorylation"
aacggttgtctcgtgggctcggagatgtgtataagagacag

SEQ ID NO: 1512 - DNA, 41 bp, Artificial Sequence
  CFor_96_TTGGCA-A_ov
  modified_base 1: /mod_base="OTHER" /note="5'-phosphorylation"
attggcagtctcgtgggctcggagatgtgtataagagacag

SEQ ID NO: 1513 - DNA, 41 bp, Artificial Sequence
  CFor_1_CGTTTC-C_ov
  modified_base 1: /mod_base="OTHER" /note="5'-phosphorylation"
ccgtttcgtctcgtgggctcggagatgtgtataagagacag

SEQ ID NO: 1514 - DNA, 41 bp, Artificial Sequence
  CFor_2_TGGTGT-C_ov
  modified_base 1: /mod_base="OTHER" /note="5'-phosphorylation"
ctggtgtgtctcgtgggctcggagatgtgtataagagacag

SEQ ID NO: 1515 - DNA, 41 bp, Artificial Sequence
  CFor_3_TCTCGA-C_ov
  modified_base 1: /mod_base="OTHER" /note="5'-phosphorylation"
ctctcgagtctcgtgggctcggagatgtgtataagagacag

SEQ ID NO: 1516 - DNA, 41 bp, Artificial Sequence
  CFor_4_GAAGGA-C_ov
  modified_base 1: /mod_base="OTHER" /note="5'-phosphorylation"
cgaaggagtctcgtgggctcggagatgtgtataagagacag

SEQ ID NO: 1517 - DNA, 41 bp, Artificial Sequence
  CFor_5_GAACAG-C_ov
  modified_base 1: /mod_base="OTHER" /note="5'-phosphorylation"
cgaacaggtctcgtgggctcggagatgtgtataagagacag

SEQ ID NO: 1518 - DNA, 41 bp, Artificial Sequence
  CFor_6_GAAACC-C_ov
  modified_base 1: /mod_base="OTHER" /note="5'-phosphorylation"
cgaaaccgtctcgtgggctcggagatgtgtataagagacag

SEQ ID NO: 1519 - DNA, 41 bp, Artificial Sequence
  CFor_7_CAACCA-C_ov
  modified_base 1: /mod_base="OTHER" /note="5'-phosphorylation"
ccaaccagtctcgtgggctcggagatgtgtataagagacag

SEQ ID NO: 1520 - DNA, 41 bp, Artificial Sequence
  CFor_8_CAAAGG-C_ov
  modified_base 1: /mod_base="OTHER" /note="5'-phosphorylation"
ccaaagggtctcgtgggctcggagatgtgtataagagacag

SEQ ID NO: 1521 - DNA, 41 bp, Artificial Sequence
  CFor_9_CAAGAC-C_ov
  modified_base 1: /mod_base="OTHER" /note="5'-phosphorylation"
ccaagacgtctcgtgggctcggagatgtgtataagagacag

SEQ ID NO: 1522 - DNA, 41 bp, Artificial Sequence
  CFor_10_TAAGCG-C_ov
  modified_base 1: /mod_base="OTHER" /note="5'-phosphorylation"
ctaagcggtctcgtgggctcggagatgtgtataagagacag

SEQ ID NO: 1523 - DNA, 41 bp, Artificial Sequence
  CFor_11_TAACGC-C_ov
  modified_base 1: /mod_base="OTHER" /note="5'-phosphorylation"
ctaacgcgtctcgtgggctcggagatgtgtataagagacag

SEQ ID NO: 1524 - DNA, 41 bp, Artificial Sequence
  CFor_12_AGACGA-C_ov
  modified_base 1: /mod_base="OTHER" /note="5'-phosphorylation"
cagacgagtctcgtgggctcggagatgtgtataagagacag

SEQ ID NO: 1525 - DNA, 41 bp, Artificial Sequence
  CFor_13_AGAGAG-C_ov
  modified_base 1: /mod_base="OTHER" /note="5'-phosphorylation"
cagagaggtctcgtgggctcggagatgtgtataagagacag

SEQ ID NO: 1526 - DNA, 41 bp, Artificial Sequence
  CFor_14_AGATCC-C_ov
  modified_base 1: /mod_base="OTHER" /note="5'-phosphorylation"
cagatccgtctcgtgggctcggagatgtgtataagagacag

SEQ ID NO: 1527 - DNA, 41 bp, Artificial Sequence
  CFor_15_GGAAGT-C_ov
  modified_base 1: /mod_base="OTHER" /note="5'-phosphorylation"
cggaagtgtctcgtgggctcggagatgtgtataagagacag

SEQ ID NO: 1528 - DNA, 41 bp, Artificial Sequence
  CFor_16_CGAGTA-C_ov
  modified_base 1: /mod_base="OTHER" /note="5'-phosphorylation"
ccgagtagtctcgtgggctcggagatgtgtataagagacag

SEQ ID NO: 1529 - DNA, 41 bp, Artificial Sequence
  CFor_17_CGACAT-C_ov
  modified_base 1: /mod_base="OTHER" /note="5'-phosphorylation"
ccgacatgtctcgtgggctcggagatgtgtataagagacag

SEQ ID NO: 1530 - DNA, 41 bp, Artificial Sequence
  CFor_18_TGACTG-C_ov
  modified_base 1: /mod_base="OTHER" /note="5'-phosphorylation"
ctgactggtctcgtgggctcggagatgtgtataagagacag

SEQ ID NO: 1531 - DNA, 41 bp, Artificial Sequence
  CFor_19_ACAGCA-C_ov
  modified_base 1: /mod_base="OTHER" /note="5'-phosphorylation"
cacagcagtctcgtgggctcggagatgtgtataagagacag

SEQ ID NO: 1532 - DNA, 41 bp, Artificial Sequence
  CFor_20_ACATGG-C_ov
  modified_base 1: /mod_base="OTHER" /note="5'-phosphorylation"
cacatgggtctcgtgggctcggagatgtgtataagagacag

SEQ ID NO: 1533 - DNA, 41 bp, Artificial Sequence
  CFor_21_ACACAC-C_ov
  modified_base 1: /mod_base="OTHER" /note="5'-phosphorylation"
cacacacgtctcgtgggctcggagatgtgtataagagacag

SEQ ID NO: 1534 - DNA, 41 bp, Artificial Sequence
  CFor_22_GCACTA-C_ov
  modified_base 1: /mod_base="OTHER" /note="5'-phosphorylation"
cgcactagtctcgtgggctcggagatgtgtataagagacag

SEQ ID NO: 1535 - DNA, 41 bp, Artificial Sequence
  CFor_23_GCAGAT-C_ov
  modified_base 1: /mod_base="OTHER" /note="5'-phosphorylation"
cgcagatgtctcgtgggctcggagatgtgtataagagacag

SEQ ID NO: 1536 - DNA, 41 bp, Artificial Sequence
  CFor_24_CCAACT-C_ov
  modified_base 1: /mod_base="OTHER" /note="5'-phosphorylation"
cccaactgtctcgtgggctcggagatgtgtataagagacag

SEQ ID NO: 1537 - DNA, 41 bp, Artificial Sequence
  CFor_25_TCAGTC-C_ov
  modified_base 1: /mod_base="OTHER" /note="5'-phosphorylation"
ctcagtcgtctcgtgggctcggagatgtgtataagagacag

SEQ ID NO: 1538 - DNA, 41 bp, Artificial Sequence
  CFor_26_ATACCG-C_ov
  modified_base 1: /mod_base="OTHER" /note="5'-phosphorylation"
cataccggtctcgtgggctcggagatgtgtataagagacag

SEQ ID NO: 1539 - DNA, 41 bp, Artificial Sequence
  CFor_27_ATAGGC-C_ov
  modified_base 1: /mod_base="OTHER" /note="5'-phosphorylation"
cataggcgtctcgtgggctcggagatgtgtataagagacag

SEQ ID NO: 1540 - DNA, 41 bp, Artificial Sequence
  CFor_28_GTAGTG-C_ov
  modified_base 1: /mod_base="OTHER" /note="5'-phosphorylation"
cgtagtggtctcgtgggctcggagatgtgtataagagacag

SEQ ID NO: 1541 - DNA, 41 bp, Artificial Sequence
  CFor_29_CTACTC-C_ov
  modified_base 1: /mod_base="OTHER" /note="5'-phosphorylation"
cctactcgtctcgtgggctcggagatgtgtataagagacag

SEQ ID NO: 1542 - DNA, 41 bp, Artificial Sequence
  CFor_30_AAGACG-C_ov
  modified_base 1: /mod_base="OTHER" /note="5'-phosphorylation"
caagacggtctcgtgggctcggagatgtgtataagagacag

SEQ ID NO: 1543 - DNA, 41 bp, Artificial Sequence
  CFor_31_AAGTGC-C_ov
  modified_base 1: /mod_base="OTHER" /note="5'-phosphorylation"
caagtgcgtctcgtgggctcggagatgtgtataagagacag

SEQ ID NO: 1544 - DNA, 41 bp, Artificial Sequence
  CFor_32_GAGTCA-C_ov
  modified_base 1: /mod_base="OTHER" /note="5'-phosphorylation"
cgagtcagtctcgtgggctcggagatgtgtataagagacag

SEQ ID NO: 1545 - DNA, 41 bp, Artificial Sequence
  CFor_33_GAGGTT-C_ov
  modified_base 1: /mod_base="OTHER" /note="5'-phosphorylation"
cgaggttgtctcgtgggctcggagatgtgtataagagacag

SEQ ID NO: 1546 - DNA, 41 bp, Artificial Sequence
  CFor_34_CAGTAG-C_ov
  modified_base 1: /mod_base="OTHER" /note="5'-phosphorylation"
ccagtaggtctcgtgggctcggagatgtgtataagagacag

SEQ ID NO: 1547 - DNA, 41 bp, Artificial Sequence
  CFor_35_CAGATC-C_ov
  modified_base 1: /mod_base="OTHER" /note="5'-phosphorylation"
ccagatcgtctcgtgggctcggagatgtgtataagagacag

SEQ ID NO: 1548 - DNA, 41 bp, Artificial Sequence
  CFor_36_TAGCCT-C_ov
  modified_base 1: /mod_base="OTHER" /note="5'-phosphorylation"
ctagcctgtctcgtgggctcggagatgtgtataagagacag

SEQ ID NO: 1549 - DNA, 41 bp, Artificial Sequence
  CFor_37_AGGTTG-C_ov
  modified_base 1: /mod_base="OTHER" /note="5'-phosphorylation"
caggttggtctcgtgggctcggagatgtgtataagagacag

SEQ ID NO: 1550 - DNA, 41 bp, Artificial Sequence
  CFor_38_AGGAAC-C_ov
  modified_base 1: /mod_base="OTHER" /note="5'-phosphorylation"
caggaacgtctcgtgggctcggagatgtgtataagagacag

SEQ ID NO: 1551 - DNA, 41 bp, Artificial Sequence
  CFor_39_TGGGAA-C_ov
  modified_base 1: /mod_base="OTHER" /note="5'-phosphorylation"
ctgggaagtctcgtgggctcggagatgtgtataagagacag

SEQ ID NO: 1552 - DNA, 41 bp, Artificial Sequence
  CFor_40_ACGAGA-C_ov
  modified_base 1: /mod_base="OTHER" /note="5'-phosphorylation"
cacgagagtctcgtgggctcggagatgtgtataagagacag

SEQ ID NO: 1553 - DNA, 41 bp, Artificial Sequence
  CFor_41_ACGTCT-C_ov
  modified_base 1: /mod_base="OTHER" /note="5'-phosphorylation"
cacgtctgtctcgtgggctcggagatgtgtataagagacag

SEQ ID NO: 1554 - DNA, 41 bp, Artificial Sequence
  CFor_42_CCGTTA-C_ov
  modified_base 1: /mod_base="OTHER" /note="5'-phosphorylation"
cccgttagtctcgtgggctcggagatgtgtataagagacag

SEQ ID NO: 1555 - DNA, 41 bp, Artificial Sequence
  CFor_43_TCGAAG-C_ov
  modified_base 1: /mod_base="OTHER" /note="5'-phosphorylation"
ctcgaaggtctcgtgggctcggagatgtgtataagagacag

SEQ ID NO: 1556 - DNA, 41 bp, Artificial Sequence
  CFor_44_ATGCGT-C_ov
  modified_base 1: /mod_base="OTHER" /note="5'-phosphorylation"
catgcgtgtctcgtgggctcggagatgtgtataagagacag

SEQ ID NO: 1557 - DNA, 41 bp, Artificial Sequence
  CFor_45_GTGCAA-C_ov
  modified_base 1: /mod_base="OTHER" /note="5'-phosphorylation"
cgtgcaagtctcgtgggctcggagatgtgtataagagacag

SEQ ID NO: 1558 - DNA, 41 bp, Artificial Sequence
  CFor_46_GTGTTC-C_ov
  modified_base 1: /mod_base="OTHER" /note="5'-phosphorylation"
cgtgttcgtctcgtgggctcggagatgtgtataagagacag

SEQ ID NO: 1559 - DNA, 41 bp, Artificial Sequence
  CFor_47_GTGACT-C_ov
  modified_base 1: /mod_base="OTHER" /note="5'-phosphorylation"
cgtgactgtctcgtgggctcggagatgtgtataagagacag

SEQ ID NO: 1560 - DNA, 41 bp, Artificial Sequence
  CFor_48_CTGGAT-C_ov
  modified_base 1: /mod_base="OTHER" /note="5'-phosphorylation"
cctggatgtctcgtgggctcggagatgtgtataagagacag

SEQ ID NO: 1561 - DNA, 41 bp, Artificial Sequence
  CFor_49_TTGTCG-C_ov
  modified_base 1: /mod_base="OTHER" /note="5'-phosphorylation"
cttgtcggtctcgtgggctcggagatgtgtataagagacag

SEQ ID NO: 1562 - DNA, 41 bp, Artificial Sequence
  CFor_50_TTGAGC-C_ov
  modified_base 1: /mod_base="OTHER" /note="5'-phosphorylation"
cttgagcgtctcgtgggctcggagatgtgtataagagacag

SEQ ID NO: 1563 - DNA, 41 bp, Artificial Sequence
  CFor_51_AACGTG-C_ov
  modified_base 1: /mod_base="OTHER" /note="5'-phosphorylation"
caacgtggtctcgtgggctcggagatgtgtataagagacag

SEQ ID NO: 1564 - DNA, 41 bp, Artificial Sequence
  CFor_52_GACTAC-C_ov
  modified_base 1: /mod_base="OTHER" /note="5'-phosphorylation"
cgactacgtctcgtgggctcggagatgtgtataagagacag

SEQ ID NO: 1565 - DNA, 41 bp, Artificial Sequence
  CFor_53_CACTGA-C_ov
  modified_base 1: /mod_base="OTHER" /note="5'-phosphorylation"
ccactgagtctcgtgggctcggagatgtgtataagagacag

SEQ ID NO: 1566 - DNA, 41 bp, Artificial Sequence
  CFor_54_CACCTT-C_ov
  modified_base 1: /mod_base="OTHER" /note="5'-phosphorylation"
ccaccttgtctcgtgggctcggagatgtgtataagagacag

SEQ ID NO: 1567 - DNA, 41 bp, Artificial Sequence
  CFor_55_TACGGT-C_ov
  modified_base 1: /mod_base="OTHER" /note="5'-phosphorylation"
ctacggtgtctcgtgggctcggagatgtgtataagagacag

SEQ ID NO: 1568 - DNA, 41 bp, Artificial Sequence
  CFor_56_AGCACA-C_ov
  modified_base 1: /mod_base="OTHER" /note="5'-phosphorylation"
cagcacagtctcgtgggctcggagatgtgtataagagacag

SEQ ID NO: 1569 - DNA, 41 bp, Artificial Sequence
  CFor_57_GGCTTA-C_ov
  modified_base 1: /mod_base="OTHER" /note="5'-phosphorylation"
cggcttagtctcgtgggctcggagatgtgtataagagacag

SEQ ID NO: 1570 - DNA, 41 bp, Artificial Sequence
  CFor_58_TGCTAG-C_ov
  modified_base 1: /mod_base="OTHER" /note="5'-phosphorylation"
ctgctaggtctcgtgggctcggagatgtgtataagagacag

SEQ ID NO: 1571 - DNA, 41 bp, Artificial Sequence
  CFor_59_TGCATC-C_ov
  modified_base 1: /mod_base="OTHER" /note="5'-phosphorylation"
ctgcatcgtctcgtgggctcggagatgtgtataagagacag

SEQ ID NO: 1572 - DNA, 41 bp, Artificial Sequence
  CFor_60_ACCTTC-C_ov
  modified_base 1: /mod_base="OTHER" /note="5'-phosphorylation"
caccttcgtctcgtgggctcggagatgtgtataagagacag

SEQ ID NO: 1573 - DNA, 41 bp, Artificial Sequence
  CFor_61_GCCATT-C_ov
  modified_base 1: /mod_base="OTHER" /note="5'-phosphorylation"
cgccattgtctcgtgggctcggagatgtgtataagagacag

SEQ ID NO: 1574 - DNA, 41 bp, Artificial Sequence
  CFor_62_TCCTCA-C_ov
  modified_base 1: /mod_base="OTHER" /note="5'-phosphorylation"
ctcctcagtctcgtgggctcggagatgtgtataagagacag

SEQ ID NO: 1575 - DNA, 41 bp, Artificial Sequence
  CFor_63_TCCCAT-C_ov
  modified_base 1: /mod_base="OTHER" /note="5'-phosphorylation"
ctcccatgtctcgtgggctcggagatgtgtataagagacag

SEQ ID NO: 1576 - DNA, 41 bp, Artificial Sequence
  CFor_64_ATCAGG-C_ov
  modified_base 1: /mod_base="OTHER" /note="5'-phosphorylation"
catcagggtctcgtgggctcggagatgtgtataagagacag

SEQ ID NO: 1577 - DNA, 41 bp, Artificial Sequence
  CFor_65_ATCGCT-C_ov
  modified_base 1: /mod_base="OTHER" /note="5'-phosphorylation"
catcgctgtctcgtgggctcggagatgtgtataagagacag

SEQ ID NO: 1578 - DNA, 41 bp, Artificial Sequence
  CFor_66_GTCTGT-C_ov
  modified_base 1: /mod_base="OTHER" /note="5'-phosphorylation"
cgtctgtgtctcgtgggctcggagatgtgtataagagacag

SEQ ID NO: 1579 - DNA, 41 bp, Artificial Sequence
  CFor_67_CTCTTG-C_ov
  modified_base 1: /mod_base="OTHER" /note="5'-phosphorylation"
cctcttggtctcgtgggctcggagatgtgtataagagacag

SEQ ID NO: 1580 - DNA, 41 bp, Artificial Sequence
  CFor_68_CTCAAC-C_ov
  modified_base 1: /mod_base="OTHER" /note="5'-phosphorylation"
cctcaacgtctcgtgggctcggagatgtgtataagagacag

SEQ ID NO: 1581 - DNA, 41 bp, Artificial Sequence
  CFor_69_AATCGG-C_ov
  modified_base 1: /mod_base="OTHER" /note="5'-phosphorylation"
caatcgggtctcgtgggctcggagatgtgtataagagacag

SEQ ID NO: 1582 - DNA, 41 bp, Artificial Sequence
  CFor_70_AATGCC-C_ov
  modified_base 1: /mod_base="OTHER" /note="5'-phosphorylation"
caatgccgtctcgtgggctcggagatgtgtataagagacag

SEQ ID NO: 1583 - DNA, 41 bp, Artificial Sequence
  CFor_71_GATCTC-C_ov
  modified_base 1: /mod_base="OTHER" /note="5'-phosphorylation"
cgatctcgtctcgtgggctcggagatgtgtataagagacag

SEQ ID NO: 1584 - DNA, 41 bp, Artificial Sequence
  CFor_72_AGTGGT-C_ov
  modified_base 1: /mod_base="OTHER" /note="5'-phosphorylation"
cagtggtgtctcgtgggctcggagatgtgtataagagacag

SEQ ID NO: 1585 - DNA, 41 bp, Artificial Sequence
  CFor_73_GGTTCT-C_ov
  modified_base 1: /mod_base="OTHER" /note="5'-phosphorylation"
cggttctgtctcgtgggctcggagatgtgtataagagacag

SEQ ID NO: 1586 - DNA, 41 bp, Artificial Sequence
  CFor_74_CGTAGA-C_ov
  modified_base 1: /mod_base="OTHER" /note="5'-phosphorylation"
ccgtagagtctcgtgggctcggagatgtgtataagagacag

SEQ ID NO: 1587 - DNA, 41 bp, Artificial Sequence
  CFor_75_TGTACG-C_ov
  modified_base 1: /mod_base="OTHER" /note="5'-phosphorylation"
ctgtacggtctcgtgggctcggagatgtgtataagagacag

SEQ ID NO: 1588 - DNA, 41 bp, Artificial Sequence
  CFor_76_TGTCAC-C_ov
  modified_base 1: /mod_base="OTHER" /note="5'-phosphorylation"
ctgtcacgtctcgtgggctcggagatgtgtataagagacag

SEQ ID NO: 1589 - DNA, 41 bp, Artificial Sequence
  CFor_77_GCTACA-C_ov
  modified_base 1: /mod_base="OTHER" /note="5'-phosphorylation"
cgctacagtctcgtgggctcggagatgtgtataagagacag

SEQ ID NO: 1590 - DNA, 41 bp, Artificial Sequence
  CFor_78_GCTTAG-C_ov
  modified_base 1: /mod_base="OTHER" /note="5'-phosphorylation"
cgcttaggtctcgtgggctcggagatgtgtataagagacag

SEQ ID NO: 1591 - DNA, 41 bp, Artificial Sequence
  CFor_79_CCTGAA-C_ov
  modified_base 1: /mod_base="OTHER" /note="5'-phosphorylation"
ccctgaagtctcgtgggctcggagatgtgtataagagacag

SEQ ID NO: 1592 - DNA, 41 bp, Artificial Sequence
  CFor_80_CCTATG-C_ov
  modified_base 1: /mod_base="OTHER" /note="5'-phosphorylation"
ccctatggtctcgtgggctcggagatgtgtataagagacag

SEQ ID NO: 1593 - DNA, 41 bp, Artificial Sequence
  CFor_81_CCTTGT-C_ov
  modified_base 1: /mod_base="OTHER" /note="5'-phosphorylation"
cccttgtgtctcgtgggctcggagatgtgtataagagacag

SEQ ID NO: 1594 - DNA, 41 bp, Artificial Sequence
  CFor_82_TCTGCT-C_ov
  modified_base 1: /mod_base="OTHER" /note="5'-phosphorylation"
ctctgctgtctcgtgggctcggagatgtgtataagagacag

SEQ ID NO: 1595 - DNA, 41 bp, Artificial Sequence
  CFor_83_GTTGAC-C_ov
  modified_base 1: /mod_base="OTHER" /note="5'-phosphorylation"
cgttgacgtctcgtgggctcggagatgtgtataagagacag

SEQ ID NO: 1596 - DNA, 41 bp, Artificial Sequence
  CFor_84_CTTCAG-C_ov
  modified_base 1: /mod_base="OTHER" /note="5'-phosphorylation"
ccttcaggtctcgtgggctcggagatgtgtataagagacag

SEQ ID NO: 1597 - DNA, 41 bp, Artificial Sequence
  CFor_85_TCGTAC-C_ov
  modified_base 1: /mod_base="OTHER" /note="5'-phosphorylation"
ctcgtacgtctcgtgggctcggagatgtgtataagagacag

SEQ ID NO: 1598 - DNA, 41 bp, Artificial Sequence
  CFor_86_TTCGGA-C_ov
  modified_base 1: /mod_base="OTHER" /note="5'-phosphorylation"
cttcggagtctcgtgggctcggagatgtgtataagagacag

SEQ ID NO: 1599 - DNA, 41 bp, Artificial Sequence
  CFor_87_TTCCCA-C_ov
  modified_base 1: /mod_base="OTHER" /note="5'-phosphorylation"
cttcccagtctcgtgggctcggagatgtgtataagagacag

SEQ ID NO: 1600 - DNA, 41 bp, Artificial Sequence
  CFor_88_CTTGCA-C_ov
  modified_base 1: /mod_base="OTHER" /note="5'-phosphorylation"
ccttgcagtctcgtgggctcggagatgtgtataagagacag

SEQ ID NO: 1601 - DNA, 41 bp, Artificial Sequence
  CFor_89_CTTCCT-C_ov
  modified_base 1: /mod_base="OTHER" /note="5'-phosphorylation"
ccttcctgtctcgtgggctcggagatgtgtataagagacag

SEQ ID NO: 1602 - DNA, 41 bp, Artificial Sequence
  CFor_90_GTACCT-C_ov
  modified_base 1: /mod_base="OTHER" /note="5'-phosphorylation"
cgtacctgtctcgtgggctcggagatgtgtataagagacag

SEQ ID NO: 1603 - DNA, 41 bp, Artificial Sequence
  CFor_91_CAGAGT-C_ov
  modified_base 1: /mod_base="OTHER" /note="5'-phosphorylation"
ccagagtgtctcgtgggctcggagatgtgtataagagacag

SEQ ID NO: 1604 - DNA, 41 bp, Artificial Sequence
  CFor_92_TAGGAC-C_ov
  modified_base 1: /mod_base="OTHER" /note="5'-phosphorylation"
ctaggacgtctcgtgggctcggagatgtgtataagagacag

SEQ ID NO: 1605 - DNA, 41 bp, Artificial Sequence
  CFor_93_AGGCTT-C_ov
  modified_base 1: /mod_base="OTHER" /note="5'-phosphorylation"
caggcttgtctcgtgggctcggagatgtgtataagagacag

SEQ ID NO: 1606 - DNA, 41 bp, Artificial Sequence
  CFor_94_TGGCTA-C_ov
  modified_base 1: /mod_base="OTHER" /note="5'-phosphorylation"
ctggctagtctcgtgggctcggagatgtgtataagagacag

SEQ ID NO: 1607 - DNA, 41 bp, Artificial Sequence
  CFor_95_ACGGTT-C_ov
  modified_base 1: /mod_base="OTHER" /note="5'-phosphorylation"
cacggttgtctcgtgggctcggagatgtgtataagagacag

SEQ ID NO: 1608 - DNA, 41 bp, Artificial Sequence
  CFor_96_TTGGCA-C_ov
  modified_base 1: /mod_base="OTHER" /note="5'-phosphorylation"
cttggcagtctcgtgggctcggagatgtgtataagagacag

SEQ ID NO: 1609 - DNA, 40 bp, Artificial Sequence
  DFor_1_GTTTCC-T_ov
  modified_base 1: /mod_base="OTHER" /note="5'-phosphorylation"
tgtttcctcgtcggcagcgtcagatgtgtataagagacag

SEQ ID NO: 1610 - DNA, 40 bp, Artificial Sequence
  DFor_2_GGTGTT-T_ov
  modified_base 1: /mod_base="OTHER" /note="5'-phosphorylation"
tggtgtttcgtcggcagcgtcagatgtgtataagagacag

SEQ ID NO: 1611 - DNA, 40 bp, Artificial Sequence
  DFor_3_CTCGAT-T_ov
  modified_base 1: /mod_base="OTHER" /note="5'-phosphorylation"
tctcgattcgtcggcagcgtcagatgtgtataagagacag

SEQ ID NO: 1612 - DNA, 40 bp, Artificial Sequence
  DFor_4_AAGGAG-T_ov
  modified_base 1: /mod_base="OTHER" /note="5'-phosphorylation"
taaggagtcgtcggcagcgtcagatgtgtataagagacag

SEQ ID NO: 1613 - DNA, 40 bp, Artificial Sequence
  DFor_5_AACAGG-T_ov
  modified_base 1: /mod_base="OTHER" /note="5'-phosphorylation"
taacaggtcgtcggcagcgtcagatgtgtataagagacag

SEQ ID NO: 1614 - DNA, 40 bp, Artificial Sequence
  DFor_6_AAACCG-T_ov
  modified_base 1: /mod_base="OTHER" /note="5'-phosphorylation"
taaaccgtcgtcggcagcgtcagatgtgtataagagacag

SEQ ID NO: 1615 - DNA, 40 bp, Artificial Sequence
  DFor_7_AACCAC-T_ov
  modified_base 1: /mod_base="OTHER" /note="5'-phosphorylation"
taaccactcgtcggcagcgtcagatgtgtataagagacag

SEQ ID NO: 1616 - DNA, 40 bp, Artificial Sequence
  DFor_8_AAAGGC-T_ov
  modified_base 1: /mod_base="OTHER" /note="5'-phosphorylation"
taaaggctcgtcggcagcgtcagatgtgtataagagacag

SEQ ID NO: 1617 - DNA, 40 bp, Artificial Sequence
  DFor_9_AAGACC-T_ov
  modified_base 1: /mod_base="OTHER" /note="5'-phosphorylation"
taagacctcgtcggcagcgtcagatgtgtataagagacag

SEQ ID NO: 1618 - DNA, 40 bp, Artificial Sequence
  DFor_10_AAGCGT-T_ov
  modified_base 1: /mod_base="OTHER" /note="5'-phosphorylation"
taagcgttcgtcggcagcgtcagatgtgtataagagacag

SEQ ID NO: 1619 - DNA, 40 bp, Artificial Sequence
  DFor_11_AACGCT-T_ov
  modified_base 1: /mod_base="OTHER" /note="5'-phosphorylation"
taacgcttcgtcggcagcgtcagatgtgtataagagacag

SEQ ID NO: 1620 - DNA, 40 bp, Artificial Sequence
  DFor_12_GACGAA-T_ov
  modified_base 1: /mod_base="OTHER" /note="5'-phosphorylation"
tgacgaatcgtcggcagcgtcagatgtgtataagagacag

SEQ ID NO: 1621 - DNA, 40 bp, Artificial Sequence
  DFor_13_GAGAGA-T_ov
  modified_base 1: /mod_base="OTHER" /note="5'-phosphorylation"
tgagagatcgtcggcagcgtcagatgtgtataagagacag

SEQ ID NO: 1622 - DNA, 40 bp, Artificial Sequence
  DFor_14_GATCCA-T_ov
  modified_base 1: /mod_base="OTHER" /note="5'-phosphorylation"
tgatccatcgtcggcagcgtcagatgtgtataagagacag

SEQ ID NO: 1623 - DNA, 40 bp, Artificial Sequence
  DFor_15_GAAGTG-T_ov
  modified_base 1: /mod_base="OTHER" /note="5'-phosphorylation"
tgaagtgtcgtcggcagcgtcagatgtgtataagagacag

SEQ ID NO: 1624 - DNA, 40 bp, Artificial Sequence
  DFor_16_GAGTAC-T_ov
  modified_base 1: /mod_base="OTHER" /note="5'-phosphorylation"
tgagtactcgtcggcagcgtcagatgtgtataagagacag

SEQ ID NO: 1625 - DNA, 40 bp, Artificial Sequence
  DFor_17_GACATC-T_ov
  modified_base 1: /mod_base="OTHER" /note="5'-phosphorylation"
tgacatctcgtcggcagcgtcagatgtgtataagagacag

SEQ ID NO: 1626 - DNA, 40 bp, Artificial Sequence
  DFor_18_GACTGT-T_ov
  modified_base 1: /mod_base="OTHER" /note="5'-phosphorylation"
tgactgttcgtcggcagcgtcagatgtgtataagagacag

SEQ ID NO: 1627 - DNA, 40 bp, Artificial Sequence
  DFor_19_CAGCAA-T_ov
  modified_base 1: /mod_base="OTHER" /note="5'-phosphorylation"
tcagcaatcgtcggcagcgtcagatgtgtataagagacag

SEQ ID NO: 1628 - DNA, 40 bp, Artificial Sequence
  DFor_20_CATGGA-T_ov
  modified_base 1: /mod_base="OTHER" /note="5'-phosphorylation"
tcatggatcgtcggcagcgtcagatgtgtataagagacag

SEQ ID NO: 1629 - DNA, 40 bp, Artificial Sequence
  DFor_21_CACACA-T_ov
  modified_base 1: /mod_base="OTHER" /note="5'-phosphorylation"
tcacacatcgtcggcagcgtcagatgtgtataagagacag

SEQ ID NO: 1630 - DNA, 40 bp, Artificial Sequence
  DFor_22_CACTAG-T_ov
  modified_base 1: /mod_base="OTHER" /note="5'-phosphorylation"
tcactagtcgtcggcagcgtcagatgtgtataagagacag

SEQ ID NO: 1631 - DNA, 40 bp, Artificial Sequence
  DFor_23_CAGATG-T_ov
  modified_base 1: /mod_base="OTHER" /note="5'-phosphorylation"
tcagatgtcgtcggcagcgtcagatgtgtataagagacag

SEQ ID NO: 1632 - DNA, 40 bp, Artificial Sequence
  DFor_24_CAACTC-T_ov
  modified_base 1: /mod_base="OTHER" /note="5'-phosphorylation"
tcaactctcgtcggcagcgtcagatgtgtataagagacag

SEQ ID NO: 1633 - DNA, 40 bp, Artificial Sequence
  DFor_25_CAGTCT-T_ov
  modified_base 1: /mod_base="OTHER" /note="5'-phosphorylation"
tcagtcttcgtcggcagcgtcagatgtgtataagagacag

SEQ ID NO: 1634 - DNA, 40 bp, Artificial Sequence
  DFor_26_TACCGA-T_ov
  modified_base 1: /mod_base="OTHER" /note="5'-phosphorylation"
ttaccgatcgtcggcagcgtcagatgtgtataagagacag

SEQ ID NO: 1635 - DNA, 40 bp, Artificial Sequence
  DFor_27_TAGGCA-T_ov
  modified_base 1: /mod_base="OTHER" /note="5'-phosphorylation"
ttaggcatcgtcggcagcgtcagatgtgtataagagacag

SEQ ID NO: 1636 - DNA, 40 bp, Artificial Sequence
  DFor_28_TAGTGG-T_ov
  modified_base 1: /mod_base="OTHER" /note="5'-phosphorylation"
ttagtggtcgtcggcagcgtcagatgtgtataagagacag

SEQ ID NO: 1637 - DNA, 40 bp, Artificial Sequence
  DFor_29_TACTCC-T_ov
  modified_base 1: /mod_base="OTHER" /note="5'-phosphorylation"
ttactcctcgtcggcagcgtcagatgtgtataagagacag

SEQ ID NO: 1638 - DNA, 40 bp, Artificial Sequence
  DFor_30_AGACGA-T_ov
  modified_base 1: /mod_base="OTHER" /note="5'-phosphorylation"
tagacgatcgtcggcagcgtcagatgtgtataagagacag

SEQ ID NO: 1639 - DNA, 40 bp, Artificial Sequence
  DFor_31_AGTGCA-T_ov
  modified_base 1: /mod_base="OTHER" /note="5'-phosphorylation"
tagtgcatcgtcggcagcgtcagatgtgtataagagacag

SEQ ID NO: 1640 - DNA, 40 bp, Artificial Sequence
  DFor_32_AGTCAG-T_ov
  modified_base 1: /mod_base="OTHER" /note="5'-phosphorylation"
tagtcagtcgtcggcagcgtcagatgtgtataagagacag

SEQ ID NO: 1641 - DNA, 40 bp, Artificial Sequence
  DFor_33_AGGTTG-T_ov
  modified_base 1: /mod_base="OTHER" /note="5'-phosphorylation"
taggttgtcgtcggcagcgtcagatgtgtataagagacag

SEQ ID NO: 1642 - DNA, 40 bp, Artificial Sequence
  DFor_34_AGTAGC-T_ov
  modified_base 1: /mod_base="OTHER" /note="5'-phosphorylation"
tagtagctcgtcggcagcgtcagatgtgtataagagacag

SEQ ID NO: 1643 - DNA, 40 bp, Artificial Sequence
  DFor_35_AGATCC-T_ov
  modified_base 1: /mod_base="OTHER" /note="5'-phosphorylation"
tagatcctcgtcggcagcgtcagatgtgtataagagacag

SEQ ID NO: 1644 - DNA, 40 bp, Artificial Sequence
  DFor_36_AGCCTT-T_ov
  modified_base 1: /mod_base="OTHER" /note="5'-phosphorylation"
tagcctttcgtcggcagcgtcagatgtgtataagagacag

SEQ ID NO: 1645 - DNA, 40 bp, Artificial Sequence
  DFor_37_GGTTGA-T_ov
  modified_base 1: /mod_base="OTHER" /note="5'-phosphorylation"
tggttgatcgtcggcagcgtcagatgtgtataagagacag

SEQ ID NO: 1646 - DNA, 40 bp, Artificial Sequence
  DFor_38_GGAACA-T_ov
  modified_base 1: /mod_base="OTHER" /note="5'-phosphorylation"
tggaacatcgtcggcagcgtcagatgtgtataagagacag

SEQ ID NO: 1647 - DNA, 40 bp, Artificial Sequence
  DFor_39_GGGAAT-T_ov
  modified_base 1: /mod_base="OTHER" /note="5'-phosphorylation"
tgggaattcgtcggcagcgtcagatgtgtataagagacag

SEQ ID NO: 1648 - DNA, 40 bp, Artificial Sequence
  DFor_40_CGAGAA-T_ov
  modified_base 1: /mod_base="OTHER" /note="5'-phosphorylation"
tcgagaatcgtcggcagcgtcagatgtgtataagagacag

SEQ ID NO: 1649 - DNA, 40 bp, Artificial Sequence
  DFor_41_CGTCTA-T_ov
  modified_base 1: /mod_base="OTHER" /note="5'-phosphorylation"
tcgtctatcgtcggcagcgtcagatgtgtataagagacag

SEQ ID NO: 1650 - DNA, 40 bp, Artificial Sequence
  DFor_42_CGTTAC-T_ov
  modified_base 1: /mod_base="OTHER" /note="5'-phosphorylation"
tcgttactcgtcggcagcgtcagatgtgtataagagacag

SEQ ID NO: 1651 - DNA, 40 bp, Artificial Sequence
  DFor_43_CGAAGT-T_ov
  modified_base 1: /mod_base="OTHER" /note="5'-phosphorylation"
tcgaagttcgtcggcagcgtcagatgtgtataagagacag

SEQ ID NO: 1652 - DNA, 40 bp, Artificial Sequence
  DFor_44_TGCGTA-T_ov
  modified_base 1: /mod_base="OTHER" /note="5'-phosphorylation"
ttgcgtatcgtcggcagcgtcagatgtgtataagagacag

SEQ ID NO: 1653 - DNA, 40 bp, Artificial Sequence
  DFor_45_TGCAAG-T_ov
  modified_base 1: /mod_base="OTHER" /note="5'-phosphorylation"
ttgcaagtcgtcggcagcgtcagatgtgtataagagacag

SEQ ID NO: 1654 - DNA, 40 bp, Artificial Sequence
  DFor_46_TGTTCG-T_ov
  modified_base 1: /mod_base="OTHER" /note="5'-phosphorylation"
ttgttcgtcgtcggcagcgtcagatgtgtataagagacag

SEQ ID NO: 1655 - DNA, 40 bp, Artificial Sequence
  DFor_47_TGACTG-T_ov
  modified_base 1: /mod_base="OTHER" /note="5'-phosphorylation"
ttgactgtcgtcggcagcgtcagatgtgtataagagacag

SEQ ID NO: 1656 - DNA, 40 bp, Artificial Sequence
  DFor_48_TGGATC-T_ov
  modified_base 1: /mod_base="OTHER" /note="5'-phosphorylation"
ttggatctcgtcggcagcgtcagatgtgtataagagacag

SEQ ID NO: 1657 - DNA, 40 bp, Artificial Sequence
  DFor_49_TGTCGT-T_ov
  modified_base 1: /mod_base="OTHER" /note="5'-phosphorylation"
ttgtcgttcgtcggcagcgtcagatgtgtataagagacag

SEQ ID NO: 1658 - DNA, 40 bp, Artificial Sequence
  DFor_50_TGAGCT-T_ov
  modified_base 1: /mod_base="OTHER" /note="5'-phosphorylation"
ttgagcttcgtcggcagcgtcagatgtgtataagagacag

SEQ ID NO: 1659 - DNA, 40 bp, Artificial Sequence
  DFor_51_ACGTGA-T_ov
  modified_base 1: /mod_base="OTHER" /note="5'-phosphorylation"
tacgtgatcgtcggcagcgtcagatgtgtataagagacag

SEQ ID NO: 1660 - DNA, 40 bp, Artificial Sequence
  DFor_52_ACTACG-T_ov
  modified_base 1: /mod_base="OTHER" /note="5'-phosphorylation"
tactacgtcgtcggcagcgtcagatgtgtataagagacag

SEQ ID NO: 1661 - DNA, 40 bp, Artificial Sequence
  DFor_53_ACTGAC-T_ov
  modified_base 1: /mod_base="OTHER" /note="5'-phosphorylation"
tactgactcgtcggcagcgtcagatgtgtataagagacag

SEQ ID NO: 1662 - DNA, 40 bp, Artificial Sequence
  DFor_54_ACCTTC-T_ov
  modified_base 1: /mod_base="OTHER" /note="5'-phosphorylation"
taccttctcgtcggcagcgtcagatgtgtataagagacag

SEQ ID NO: 1663 - DNA, 40 bp, Artificial Sequence
  DFor_55_ACGGTT-T_ov
  modified_base 1: /mod_base="OTHER" /note="5'-phosphorylation"
tacggtttcgtcggcagcgtcagatgtgtataagagacag

SEQ ID NO: 1664 - DNA, 40 bp, Artificial Sequence
  DFor_56_GCACAA-T_ov
  modified_base 1: /mod_base="OTHER" /note="5'-phosphorylation"
tgcacaatcgtcggcagcgtcagatgtgtataagagacag

SEQ ID NO: 1665 - DNA, 40 bp, Artificial Sequence
  DFor_57_GCTTAG-T_ov
  modified_base 1: /mod_base="OTHER" /note="5'-phosphorylation"
tgcttagtcgtcggcagcgtcagatgtgtataagagacag

SEQ ID NO: 1666 - DNA, 40 bp, Artificial Sequence
  DFor_58_GCTAGT-T_ov
  modified_base 1: /mod_base="OTHER" /note="5'-phosphorylation"
tgctagttcgtcggcagcgtcagatgtgtataagagacag

SEQ ID NO: 1667 - DNA, 40 bp, Artificial Sequence
  DFor_59_GCATCT-T_ov
  modified_base 1: /mod_base="OTHER" /note="5'-phosphorylation"
tgcatcttcgtcggcagcgtcagatgtgtataagagacag

SEQ ID NO: 1668 - DNA, 40 bp, Artificial Sequence
  DFor_60_CCTTCA-T_ov
  modified_base 1: /mod_base="OTHER" /note="5'-phosphorylation"
tccttcatcgtcggcagcgtcagatgtgtataagagacag

SEQ ID NO: 1669 - DNA, 40 bp, Artificial Sequence
  DFor_61_CCATTG-T_ov
  modified_base 1: /mod_base="OTHER" /note="5'-phosphorylation"
tccattgtcgtcggcagcgtcagatgtgtataagagacag

SEQ ID NO: 1670 - DNA, 40 bp, Artificial Sequence
  DFor_62_CCTCAT-T_ov
  modified_base 1: /mod_base="OTHER" /note="5'-phosphorylation"
tcctcattcgtcggcagcgtcagatgtgtataagagacag

SEQ ID NO: 1671 - DNA, 40 bp, Artificial Sequence
  DFor_63_CCCATT-T_ov
  modified_base 1: /mod_base="OTHER" /note="5'-phosphorylation"
tcccatttcgtcggcagcgtcagatgtgtataagagacag

SEQ ID NO: 1672 - DNA, 40 bp, Artificial Sequence
  DFor_64_TCAGGA-T_ov
  modified_base 1: /mod_base="OTHER" /note="5'-phosphorylation"
ttcaggatcgtcggcagcgtcagatgtgtataagagacag

SEQ ID NO: 1673 - DNA, 40 bp, Artificial Sequence
  DFor_65_TCGCTA-T_ov
  modified_base 1: /mod_base="OTHER" /note="5'-phosphorylation"
ttcgctatcgtcggcagcgtcagatgtgtataagagacag

SEQ ID NO: 1674 - DNA, 40 bp, Artificial Sequence
  DFor_66_TCTGTG-T_ov
  modified_base 1: /mod_base="OTHER" /note="5'-phosphorylation"
ttctgtgtcgtcggcagcgtcagatgtgtataagagacag

SEQ ID NO: 1675 - DNA, 40 bp, Artificial Sequence
  DFor_67_TCTTGC-T_ov
  modified_base 1: /mod_base="OTHER" /note="5'-phosphorylation"
ttcttgctcgtcggcagcgtcagatgtgtataagagacag

SEQ ID NO: 1676 - DNA, 40 bp, Artificial Sequence
  DFor_68_TCAACC-T_ov
  modified_base 1: /mod_base="OTHER" /note="5'-phosphorylation"
ttcaacctcgtcggcagcgtcagatgtgtataagagacag

SEQ ID NO: 1677 - DNA, 40 bp, Artificial Sequence
  DFor_69_ATCGGA-T_ov
  modified_base 1: /mod_base="OTHER" /note="5'-phosphorylation"
tatcggatcgtcggcagcgtcagatgtgtataagagacag

SEQ ID NO: 1678 - DNA, 40 bp, Artificial Sequence
  DFor_70_ATGCCA-T_ov
  modified_base 1: /mod_base="OTHER" /note="5'-phosphorylation"
tatgccatcgtcggcagcgtcagatgtgtataagagacag

SEQ ID NO: 1679 - DNA, 40 bp, Artificial Sequence
  DFor_71_ATCTCG-T_ov
  modified_base 1: /mod_base="OTHER" /note="5'-phosphorylation"
tatctcgtcgtcggcagcgtcagatgtgtataagagacag

SEQ ID NO: 1680 - DNA, 40 bp, Artificial Sequence
  DFor_72_GTGGTA-T_ov
  modified_base 1: /mod_base="OTHER" /note="5'-phosphorylation"
tgtggtatcgtcggcagcgtcagatgtgtataagagacag

SEQ ID NO: 1681 - DNA, 40 bp, Artificial Sequence
  DFor_73_GTTCTG-T_ov
  modified_base 1: /mod_base="OTHER" /note="5'-phosphorylation"
tgttctgtcgtcggcagcgtcagatgtgtataagagacag

SEQ ID NO: 1682 - DNA, 40 bp, Artificial Sequence
  DFor_74_GTAGAC-T_ov
  modified_base 1: /mod_base="OTHER" /note="5'-phosphorylation"
tgtagactcgtcggcagcgtcagatgtgtataagagacag

SEQ ID NO: 1683 - DNA, 40 bp, Artificial Sequence
  DFor_75_GTACGT-T_ov
  modified_base 1: /mod_base="OTHER" /note="5'-phosphorylation"
tgtacgttcgtcggcagcgtcagatgtgtataagagacag

SEQ ID NO: 1684 - DNA, 40 bp, Artificial Sequence
  DFor_76_GTCACT-T_ov
  modified_base 1: /mod_base="OTHER" /note="5'-phosphorylation"
tgtcacttcgtcggcagcgtcagatgtgtataagagacag

SEQ ID NO: 1685 - DNA, 40 bp, Artificial Sequence
  DFor_77_CTACAG-T_ov
  modified_base 1: /mod_base="OTHER" /note="5'-phosphorylation"
tctacagtcgtcggcagcgtcagatgtgtataagagacag

SEQ ID NO: 1686 - DNA, 40 bp, Artificial Sequence
  DFor_78_CTTAGG-T_ov
  modified_base 1: /mod_base="OTHER" /note="5'-phosphorylation"
tcttaggtcgtcggcagcgtcagatgtgtataagagacag

SEQ ID NO: 1687 - DNA, 40 bp, Artificial Sequence
  DFor_79_CTGAAC-T_ov
  modified_base 1: /mod_base="OTHER" /note="5'-phosphorylation"
tctgaactcgtcggcagcgtcagatgtgtataagagacag

SEQ ID NO: 1688 - DNA, 40 bp, Artificial Sequence
  DFor_80_CTATGC-T_ov
  modified_base 1: /mod_base="OTHER" /note="5'-phosphorylation"
tctatgctcgtcggcagcgtcagatgtgtataagagacag

SEQ ID NO: 1689 - DNA, 40 bp, Artificial Sequence
  DFor_81_CTTGTC-T_ov
  modified_base 1: /mod_base="OTHER" /note="5'-phosphorylation"
tcttgtctcgtcggcagcgtcagatgtgtataagagacag

SEQ ID NO: 1690 - DNA, 40 bp, Artificial Sequence
  DFor_82_CTGCTT-T_ov
  modified_base 1: /mod_base="OTHER" /note="5'-phosphorylation"
tctgctttcgtcggcagcgtcagatgtgtataagagacag

SEQ ID NO: 1691 - DNA, 40 bp, Artificial Sequence
  DFor_83_TTGACG-T_ov
  modified_base 1: /mod_base="OTHER" /note="5'-phosphorylation"
tttgacgtcgtcggcagcgtcagatgtgtataagagacag

SEQ ID NO: 1692 - DNA, 40 bp, Artificial Sequence
  DFor_84_TTCAGC-T_ov
  modified_base 1: /mod_base="OTHER" /note="5'-phosphorylation"
tttcagctcgtcggcagcgtcagatgtgtataagagacag

SEQ ID NO: 1693 - DNA, 40 bp, Artificial Sequence
  DFor_85_CGTACT-T_ov
  modified_base 1: /mod_base="OTHER" /note="5'-phosphorylation"
tcgtacttcgtcggcagcgtcagatgtgtataagagacag

SEQ ID NO: 1694 - DNA, 40 bp, Artificial Sequence
  DFor_86_TCGGAT-T_ov
  modified_base 1: /mod_base="OTHER" /note="5'-phosphorylation"
ttcggattcgtcggcagcgtcagatgtgtataagagacag

SEQ ID NO: 1695 - DNA, 40 bp, Artificial Sequence
  DFor_87_TCCCAT-T_ov
  modified_base 1: /mod_base="OTHER" /note="5'-phosphorylation"
ttcccattcgtcggcagcgtcagatgtgtataagagacag

SEQ ID NO: 1696 - DNA, 40 bp, Artificial Sequence
  DFor_88_TTGCAC-T_ov
  modified_base 1: /mod_base="OTHER" /note="5'-phosphorylation"
tttgcactcgtcggcagcgtcagatgtgtataagagacag

SEQ ID NO: 1697 - DNA, 40 bp, Artificial Sequence
  DFor_89_TTCCTC-T_ov
  modified_base 1: /mod_base="OTHER" /note="5'-phosphorylation"
tttcctctcgtcggcagcgtcagatgtgtataagagacag

SEQ ID NO: 1698 - DNA, 40 bp, Artificial Sequence
  DFor_90_TACCTG-T_ov
  modified_base 1: /mod_base="OTHER" /note="5'-phosphorylation"
ttacctgtcgtcggcagcgtcagatgtgtataagagacag

SEQ ID NO: 1699 - DNA, 40 bp, Artificial Sequence
  DFor_91_AGAGTC-T_ov
  modified_base 1: /mod_base="OTHER" /note="5'-phosphorylation"
tagagtctcgtcggcagcgtcagatgtgtataagagacag

SEQ ID NO: 1700 - DNA, 40 bp, Artificial Sequence
  DFor_92_AGGACT-T_ov
  modified_base 1: /mod_base="OTHER" /note="5'-phosphorylation"
taggacttcgtcggcagcgtcagatgtgtataagagacag

SEQ ID NO: 1701 - DNA, 40 bp, Artificial Sequence
  DFor_93_GGCTTA-T_ov
  modified_base 1: /mod_base="OTHER" /note="5'-phosphorylation"
tggcttatcgtcggcagcgtcagatgtgtataagagacag

SEQ ID NO: 1702 - DNA, 40 bp, Artificial Sequence
  DFor_94_GGCTAT-T_ov
  modified_base 1: /mod_base="OTHER" /note="5'-phosphorylation"
tggctattcgtcggcagcgtcagatgtgtataagagacag

SEQ ID NO: 1703 - DNA, 40 bp, Artificial Sequence
  DFor_95_CGGTTA-T_ov
  modified_base 1: /mod_base="OTHER" /note="5'-phosphorylation"
tcggttatcgtcggcagcgtcagatgtgtataagagacag

SEQ ID NO: 1704 - DNA, 40 bp, Artificial Sequence
  DFor_96_TGGCAT-T_ov
  modified_base 1: /mod_base="OTHER" /note="5'-phosphorylation"
ttggcattcgtcggcagcgtcagatgtgtataagagacag

SEQ ID NO: 1705 - DNA, 40 bp, Artificial Sequence
  DFor_1_GTTTCC-G_ov
  modified_base 1: /mod_base="OTHER" /note="5'-phosphorylation"
ggtttcctcgtcggcagcgtcagatgtgtataagagacag

SEQ ID NO: 1706 - DNA, 40 bp, Artificial Sequence
  DFor_2_GGTGTT-G_ov
  modified_base 1: /mod_base="OTHER" /note="5'-phosphorylation"
gggtgtttcgtcggcagcgtcagatgtgtataagagacag

SEQ ID NO: 1707 - DNA, 40 bp, Artificial Sequence
  DFor_3_CTCGAT-G_ov
  modified_base 1: /mod_base="OTHER" /note="5'-phosphorylation"
gctcgattcgtcggcagcgtcagatgtgtataagagacag

SEQ ID NO: 1708 - DNA, 40 bp, Artificial Sequence
  DFor_4_AAGGAG-G_ov
  modified_base 1: /mod_base="OTHER" /note="5'-phosphorylation"
gaaggagtcgtcggcagcgtcagatgtgtataagagacag

SEQ ID NO: 1709 - DNA, 40 bp, Artificial Sequence
  DFor_5_AACAGG-G_ov
  modified_base 1: /mod_base="OTHER" /note="5'-phosphorylation"
gaacaggtcgtcggcagcgtcagatgtgtataagagacag

SEQ ID NO: 1710 - DNA, 40 bp, Artificial Sequence
  DFor_6_AAACCG-G_ov
  modified_base 1: /mod_base="OTHER" /note="5'-phosphorylation"
gaaaccgtcgtcggcagcgtcagatgtgtataagagacag

SEQ ID NO: 1711 - DNA, 40 bp, Artificial Sequence
  DFor_7_AACCAC-G_ov
  modified_base 1: /mod_base="OTHER" /note="5'-phosphorylation"
gaaccactcgtcggcagcgtcagatgtgtataagagacag

SEQ ID NO: 1712 - DNA, 40 bp, Artificial Sequence
  DFor_8_AAAGGC-G_ov
  modified_base 1: /mod_base="OTHER" /note="5'-phosphorylation"
gaaaggctcgtcggcagcgtcagatgtgtataagagacag

SEQ ID NO: 1713 - DNA, 40 bp, Artificial Sequence
  DFor_9_AAGACC-G_ov
  modified_base 1: /mod_base="OTHER" /note="5'-phosphorylation"
gaagacctcgtcggcagcgtcagatgtgtataagagacag

SEQ ID NO: 1714 - DNA, 40 bp, Artificial Sequence
  DFor_10_AAGCGT-G_ov
  modified_base 1: /mod_base="OTHER" /note="5'-phosphorylation"
gaagcgttcgtcggcagcgtcagatgtgtataagagacag

SEQ ID NO: 1715 - DNA, 40 bp, Artificial Sequence
  DFor_11_AACGCT-G_ov
  modified_base 1: /mod_base="OTHER" /note="5'-phosphorylation"
gaacgcttcgtcggcagcgtcagatgtgtataagagacag

SEQ ID NO: 1716 - DNA, 40 bp, Artificial Sequence
  DFor_12_GACGAA-G_ov
  modified_base 1: /mod_base="OTHER" /note="5'-phosphorylation"
ggacgaatcgtcggcagcgtcagatgtgtataagagacag

SEQ ID NO: 1717 - DNA, 40 bp, Artificial Sequence
  DFor_13_GAGAGA-G_ov
  modified_base 1: /mod_base="OTHER" /note="5'-phosphorylation"
ggagagatcgtcggcagcgtcagatgtgtataagagacag

SEQ ID NO: 1718 - DNA, 40 bp, Artificial Sequence
  DFor_14_GATCCA-G_ov
  modified_base 1: /mod_base="OTHER" /note="5'-phosphorylation"
ggatccatcgtcggcagcgtcagatgtgtataagagacag

SEQ ID NO: 1719 - DNA, 40 bp, Artificial Sequence
  DFor_15_GAAGTG-G_ov
  modified_base 1: /mod_base="OTHER" /note="5'-phosphorylation"
ggaagtgtcgtcggcagcgtcagatgtgtataagagacag

SEQ ID NO: 1720 - DNA, 40 bp, Artificial Sequence
  DFor_16_GAGTAC-G_ov
  modified_base 1: /mod_base="OTHER" /note="5'-phosphorylation"
ggagtactcgtcggcagcgtcagatgtgtataagagacag

SEQ ID NO: 1721 - DNA, 40 bp, Artificial Sequence
  DFor_17_GACATC-G_ov
  modified_base 1: /mod_base="OTHER" /note="5'-phosphorylation"
ggacatctcgtcggcagcgtcagatgtgtataagagacag

SEQ ID NO: 1722 - DNA, 40 bp, Artificial Sequence
  DFor_18_GACTGT-G_ov
  modified_base 1: /mod_base="OTHER" /note="5'-phosphorylation"
ggactgttcgtcggcagcgtcagatgtgtataagagacag

SEQ ID NO: 1723 - DNA, 40 bp, Artificial Sequence
  DFor_19_CAGCAA-G_ov
  modified_base 1: /mod_base="OTHER" /note="5'-phosphorylation"
gcagcaatcgtcggcagcgtcagatgtgtataagagacag

SEQ ID NO: 1724 - DNA, 40 bp, Artificial Sequence
  DFor_20_CATGGA-G_ov
  modified_base 1: /mod_base="OTHER" /note="5'-phosphorylation"
gcatggatcgtcggcagcgtcagatgtgtataagagacag

SEQ ID NO: 1725 - DNA, 40 bp, Artificial Sequence
  DFor_21_CACACA-G_ov
  modified_base 1: /mod_base="OTHER" /note="5'-phosphorylation"
gcacacatcgtcggcagcgtcagatgtgtataagagacag

SEQ ID NO: 1726 - DNA, 40 bp, Artificial Sequence
  DFor_22_CACTAG-G_ov
  modified_base 1: /mod_base="OTHER" /note="5'-phosphorylation"
gcactagtcgtcggcagcgtcagatgtgtataagagacag

SEQ ID NO: 1727 - DNA, 40 bp, Artificial Sequence
  DFor_23_CAGATG-G_ov
  modified_base 1: /mod_base="OTHER" /note="5'-phosphorylation"
gcagatgtcgtcggcagcgtcagatgtgtataagagacag

SEQ ID NO: 1728 - DNA, 40 bp, Artificial Sequence
  DFor_24_CAACTC-G_ov
  modified_base 1: /mod_base="OTHER" /note="5'-phosphorylation"
gcaactctcgtcggcagcgtcagatgtgtataagagacag

SEQ ID NO: 1729 - DNA, 40 bp, Artificial Sequence
  DFor_25_CAGTCT-G_ov
  modified_base 1: /mod_base="OTHER" /note="5'-phosphorylation"
gcagtcttcgtcggcagcgtcagatgtgtataagagacag

SEQ ID NO: 1730 - DNA, 40 bp, Artificial Sequence
  DFor_26_TACCGA-G_ov
  modified_base 1: /mod_base="OTHER" /note="5'-phosphorylation"
gtaccgatcgtcggcagcgtcagatgtgtataagagacag

SEQ ID NO: 1731 - DNA, 40 bp, Artificial Sequence
  DFor_27_TAGGCA-G_ov
  modified_base 1: /mod_base="OTHER" /note="5'-phosphorylation"
gtaggcatcgtcggcagcgtcagatgtgtataagagacag

SEQ ID NO: 1732 - DNA, 40 bp, Artificial Sequence
  DFor_28_TAGTGG-G_ov
  modified_base 1: /mod_base="OTHER" /note="5'-phosphorylation"
gtagtggtcgtcggcagcgtcagatgtgtataagagacag

SEQ ID NO: 1733 - DNA, 40 bp, Artificial Sequence
  DFor_29_TACTCC-G_ov
  modified_base 1: /mod_base="OTHER" /note="5'-phosphorylation"
gtactcctcgtcggcagcgtcagatgtgtataagagacag

SEQ ID NO: 1734 - DNA, 40 bp, Artificial Sequence
  DFor_30_AGACGA-G_ov
  modified_base 1: /mod_base="OTHER" /note="5'-phosphorylation"
gagacgatcgtcggcagcgtcagatgtgtataagagacag

SEQ ID NO: 1735 - DNA, 40 bp, Artificial Sequence
  DFor_31_AGTGCA-G_ov
  modified_base 1: /mod_base="OTHER" /note="5'-phosphorylation"
gagtgcatcgtcggcagcgtcagatgtgtataagagacag

SEQ ID NO: 1736 - DNA, 40 bp, Artificial Sequence
  DFor_32_AGTCAG-G_ov
  modified_base 1: /mod_base="OTHER" /note="5'-phosphorylation"
gagtcagtcgtcggcagcgtcagatgtgtataagagacag

SEQ ID NO: 1737 - DNA, 40 bp, Artificial Sequence
  DFor_33_AGGTTG-G_ov
  modified_base 1: /mod_base="OTHER" /note="5'-phosphorylation"
gaggttgtcgtcggcagcgtcagatgtgtataagagacag

SEQ ID NO: 1738 - DNA, 40 bp, Artificial Sequence
  DFor_34_AGTAGC-G_ov
  modified_base 1: /mod_base="OTHER" /note="5'-phosphorylation"
gagtagctcgtcggcagcgtcagatgtgtataagagacag

SEQ ID NO: 1739 - DNA, 40 bp, Artificial Sequence
  DFor_35_AGATCC-G_ov
  modified_base 1: /mod_base="OTHER" /note="5'-phosphorylation"
gagatcctcgtcggcagcgtcagatgtgtataagagacag

SEQ ID NO: 1740 - DNA, 40 bp, Artificial Sequence
  DFor_36_AGCCTT-G_ov
  modified_base 1: /mod_base="OTHER" /note="5'-phosphorylation"
gagcctttcgtcggcagcgtcagatgtgtataagagacag

SEQ ID NO: 1741 - DNA, 40 bp, Artificial Sequence
  DFor_37_GGTTGA-G_ov
  modified_base 1: /mod_base="OTHER" /note="5'-phosphorylation"
gggttgatcgtcggcagcgtcagatgtgtataagagacag

SEQ ID NO: 1742 - DNA, 40 bp, Artificial Sequence
  DFor_38_GGAACA-G_ov
  modified_base 1: /mod_base="OTHER" /note="5'-phosphorylation"
gggaacatcgtcggcagcgtcagatgtgtataagagacag

SEQ ID NO: 1743 - DNA, 40 bp, Artificial Sequence
  DFor_39_GGGAAT-G_ov
  modified_base 1: /mod_base="OTHER" /note="5'-phosphorylation"
ggggaattcgtcggcagcgtcagatgtgtataagagacag

SEQ ID NO: 1744 - DNA, 40 bp, Artificial Sequence
  DFor_40_CGAGAA-G_ov
  modified_base 1: /mod_base="OTHER" /note="5'-phosphorylation"
gcgagaatcgtcggcagcgtcagatgtgtataagagacag

SEQ ID NO: 1745 - DNA, 40 bp, Artificial Sequence
  DFor_41_CGTCTA-G_ov
  modified_base 1: /mod_base="OTHER" /note="5'-phosphorylation"
gcgtctatcgtcggcagcgtcagatgtgtataagagacag

SEQ ID NO: 1746 - DNA, 40 bp, Artificial Sequence
  DFor_42_CGTTAC-G_ov
  modified_base 1: /mod_base="OTHER" /note="5'-phosphorylation"
gcgttactcgtcggcagcgtcagatgtgtataagagacag

SEQ ID NO: 1747 - DNA, 40 bp, Artificial Sequence
  DFor_43_CGAAGT-G_ov
  modified_base 1: /mod_base="OTHER" /note="5'-phosphorylation"
gcgaagttcgtcggcagcgtcagatgtgtataagagacag

SEQ ID NO: 1748 - DNA, 40 bp, Artificial Sequence
  DFor_44_TGCGTA-G_ov
  modified_base 1: /mod_base="OTHER" /note="5'-phosphorylation"
gtgcgtatcgtcggcagcgtcagatgtgtataagagacag

SEQ ID NO: 1749 - DNA, 40 bp, Artificial Sequence
  DFor_45_TGCAAG-G_ov
  modified_base 1: /mod_base="OTHER" /note="5'-phosphorylation"
gtgcaagtcgtcggcagcgtcagatgtgtataagagacag

SEQ ID NO: 1750 - DNA, 40 bp, Artificial Sequence
  DFor_46_TGTTCG-G_ov
  modified_base 1: /mod_base="OTHER" /note="5'-phosphorylation"
gtgttcgtcgtcggcagcgtcagatgtgtataagagacag

SEQ ID NO: 1751 - DNA, 40 bp, Artificial Sequence
  DFor_47_TGACTG-G_ov
  modified_base 1: /mod_base="OTHER" /note="5'-phosphorylation"
gtgactgtcgtcggcagcgtcagatgtgtataagagacag

SEQ ID NO: 1752 - DNA, 40 bp, Artificial Sequence
  DFor_48_TGGATC-G_ov
  modified_base 1: /mod_base="OTHER" /note="5'-phosphorylation"
gtggatctcgtcggcagcgtcagatgtgtataagagacag

SEQ ID NO: 1753 - DNA, 40 bp, Artificial Sequence
  DFor_49_TGTCGT-G_ov
  modified_base 1: /mod_base="OTHER" /note="5'-phosphorylation"
gtgtcgttcgtcggcagcgtcagatgtgtataagagacag

SEQ ID NO: 1754 - DNA, 40 bp, Artificial Sequence
  DFor_50_TGAGCT-G_ov
  modified_base 1: /mod_base="OTHER" /note="5'-phosphorylation"
gtgagcttcgtcggcagcgtcagatgtgtataagagacag

SEQ ID NO: 1755 - DNA, 40 bp, Artificial Sequence
  DFor_51_ACGTGA-G_ov
  modified_base 1: /mod_base="OTHER" /note="5'-phosphorylation"
gacgtgatcgtcggcagcgtcagatgtgtataagagacag

SEQ ID NO: 1756 - DNA, 40 bp, Artificial Sequence
  DFor_52_ACTACG-G_ov
  modified_base 1: /mod_base="OTHER" /note="5'-phosphorylation"
gactacgtcgtcggcagcgtcagatgtgtataagagacag

SEQ ID NO: 1757 - DNA, 40 bp, Artificial Sequence
  DFor_53_ACTGAC-G_ov
  modified_base 1: /mod_base="OTHER" /note="5'-phosphorylation"
gactgactcgtcggcagcgtcagatgtgtataagagacag

SEQ ID NO: 1758 - DNA, 40 bp, Artificial Sequence
  DFor_54_ACCTTC-G_ov
  modified_base 1: /mod_base="OTHER" /note="5'-phosphorylation"
gaccttctcgtcggcagcgtcagatgtgtataagagacag

SEQ ID NO: 1759 - DNA, 40 bp, Artificial Sequence
  DFor_55_ACGGTT-G_ov
  modified_base 1: /mod_base="OTHER" /note="5'-phosphorylation"
gacggtttcgtcggcagcgtcagatgtgtataagagacag

SEQ ID NO: 1760 - DNA, 40 bp, Artificial Sequence
  DFor_56_GCACAA-G_ov
  modified_base 1: /mod_base="OTHER" /note="5'-phosphorylation"
ggcacaatcgtcggcagcgtcagatgtgtataagagacag

SEQ ID NO: 1761 - DNA, 40 bp, Artificial Sequence
  DFor_57_GCTTAG-G_ov
  modified_base 1: /mod_base="OTHER" /note="5'-phosphorylation"
ggcttagtcgtcggcagcgtcagatgtgtataagagacag

SEQ ID NO: 1762 - DNA, 40 bp, Artificial Sequence
  DFor_58_GCTAGT-G_ov
  modified_base 1: /mod_base="OTHER" /note="5'-phosphorylation"
ggctagttcgtcggcagcgtcagatgtgtataagagacag

SEQ ID NO: 1763 - DNA, 40 bp, Artificial Sequence
  DFor_59_GCATCT-G_ov
  modified_base 1: /mod_base="OTHER" /note="5'-phosphorylation"
ggcatcttcgtcggcagcgtcagatgtgtataagagacag

SEQ ID NO: 1764 - DNA, 40 bp, Artificial Sequence
  DFor_60_CCTTCA-G_ov
  modified_base 1: /mod_base="OTHER" /note="5'-phosphorylation"
gccttcatcgtcggcagcgtcagatgtgtataagagacag

SEQ ID NO: 1765 - DNA, 40 bp, Artificial Sequence
  DFor_61_CCATTG-G_ov
  modified_base 1: /mod_base="OTHER" /note="5'-phosphorylation"
gccattgtcgtcggcagcgtcagatgtgtataagagacag

SEQ ID NO: 1766 - DNA, 40 bp, Artificial Sequence
  DFor_62_CCTCAT-G_ov
  modified_base 1: /mod_base="OTHER" /note="5'-phosphorylation"
gcctcattcgtcggcagcgtcagatgtgtataagagacag

SEQ ID NO: 1767 - DNA, 40 bp, Artificial Sequence
  DFor_63_CCCATT-G_ov
  modified_base 1: /mod_base="OTHER" /note="5'-phosphorylation"
gcccatttcgtcggcagcgtcagatgtgtataagagacag

SEQ ID NO: 1768 - DNA, 40 bp, Artificial Sequence
  DFor_64_TCAGGA-G_ov
  modified_base 1: /mod_base="OTHER" /note="5'-phosphorylation"
gtcaggatcgtcggcagcgtcagatgtgtataagagacag

SEQ ID NO: 1769 - DNA, 40 bp, Artificial Sequence
  DFor_65_TCGCTA-G_ov
  modified_base 1: /mod_base="OTHER" /note="5'-phosphorylation"
gtcgctatcgtcggcagcgtcagatgtgtataagagacag

SEQ ID NO: 1770 - DNA, 40 bp, Artificial Sequence
  DFor_66_TCTGTG-G_ov
  modified_base 1: /mod_base="OTHER" /note="5'-phosphorylation"
gtctgtgtcgtcggcagcgtcagatgtgtataagagacag

SEQ ID NO: 1771 - DNA, 40 bp, Artificial Sequence
  DFor_67_TCTTGC-G_ov
  modified_base 1: /mod_base="OTHER" /note="5'-phosphorylation"
gtcttgctcgtcggcagcgtcagatgtgtataagagacag

SEQ ID NO: 1772 - DNA, 40 bp, Artificial Sequence
  DFor_68_TCAACC-G_ov
  modified_base 1: /mod_base="OTHER" /note="5'-phosphorylation"
gtcaacctcgtcggcagcgtcagatgtgtataagagacag

SEQ ID NO: 1773 - DNA, 40 bp, Artificial Sequence
  DFor_69_ATCGGA-G_ov
  modified_base 1: /mod_base="OTHER" /note="5'-phosphorylation"
gatcggatcgtcggcagcgtcagatgtgtataagagacag

SEQ ID NO: 1774 - DNA, 40 bp, Artificial Sequence
  DFor_70_ATGCCA-G_ov
  modified_base 1: /mod_base="OTHER" /note="5'-phosphorylation"
gatgccatcgtcggcagcgtcagatgtgtataagagacag

SEQ ID NO: 1775 - DNA, 40 bp, Artificial Sequence
  DFor_71_ATCTCG-G_ov
  modified_base 1: /mod_base="OTHER" /note="5'-phosphorylation"
gatctcgtcgtcggcagcgtcagatgtgtataagagacag

SEQ ID NO: 1776 - DNA, 40 bp, Artificial Sequence
  DFor_72_GTGGTA-G_ov
  modified_base 1: /mod_base="OTHER" /note="5'-phosphorylation"
ggtggtatcgtcggcagcgtcagatgtgtataagagacag

SEQ ID NO: 1777 - DNA, 40 bp, Artificial Sequence
  DFor_73_GTTCTG-G_ov
  modified_base 1: /mod_base="OTHER" /note="5'-phosphorylation"
ggttctgtcgtcggcagcgtcagatgtgtataagagacag

SEQ ID NO: 1778 - DNA, 40 bp, Artificial Sequence
  DFor_74_GTAGAC-G_ov
  modified_base 1: /mod_base="OTHER" /note="5'-phosphorylation"
ggtagactcgtcggcagcgtcagatgtgtataagagacag

SEQ ID NO: 1779 - DNA, 40 bp, Artificial Sequence
  DFor_75_GTACGT-G_ov
  modified_base 1: /mod_base="OTHER" /note="5'-phosphorylation"
ggtacgttcgtcggcagcgtcagatgtgtataagagacag

SEQ ID NO: 1780 - DNA, 40 bp, Artificial Sequence
  DFor_76_GTCACT-G_ov
  modified_base 1: /mod_base="OTHER" /note="5'-phosphorylation"
ggtcacttcgtcggcagcgtcagatgtgtataagagacag

SEQ ID NO: 1781 - DNA, 40 bp, Artificial Sequence
  DFor_77_CTACAG-G_ov
  modified_base 1: /mod_base="OTHER" /note="5'-phosphorylation"
gctacagtcgtcggcagcgtcagatgtgtataagagacag

SEQ ID NO: 1782 - DNA, 40 bp, Artificial Sequence
  DFor_78_CTTAGG-G_ov
  modified_base 1: /mod_base="OTHER" /note="5'-phosphorylation"
gcttaggtcgtcggcagcgtcagatgtgtataagagacag

SEQ ID NO: 1783 - DNA, 40 bp, Artificial Sequence
  DFor_79_CTGAAC-G_ov
  modified_base 1: /mod_base="OTHER" /note="5'-phosphorylation"
gctgaactcgtcggcagcgtcagatgtgtataagagacag

SEQ ID NO: 1784 - DNA, 40 bp, Artificial Sequence
  DFor_80_CTATGC-G_ov
  modified_base 1: /mod_base="OTHER" /note="5'-phosphorylation"
gctatgctcgtcggcagcgtcagatgtgtataagagacag

SEQ ID NO: 1785 - DNA, 40 bp, Artificial Sequence
  DFor_81_CTTGTC-G_ov
  modified_base 1: /mod_base="OTHER" /note="5'-phosphorylation"
gcttgtctcgtcggcagcgtcagatgtgtataagagacag

SEQ ID NO: 1786 - DNA, 40 bp, Artificial Sequence
  DFor_82_CTGCTT-G_ov
  modified_base 1: /mod_base="OTHER" /note="5'-phosphorylation"
gctgctttcgtcggcagcgtcagatgtgtataagagacag

SEQ ID NO: 1787 - DNA, 40 bp, Artificial Sequence
  DFor_83_TTGACG-G_ov
  modified_base 1: /mod_base="OTHER" /note="5'-phosphorylation"
gttgacgtcgtcggcagcgtcagatgtgtataagagacag

SEQ ID NO: 1788 - DNA, 40 bp, Artificial Sequence
  DFor_84_TTCAGC-G_ov
  modified_base 1: /mod_base="OTHER" /note="5'-phosphorylation"
gttcagctcgtcggcagcgtcagatgtgtataagagacag

SEQ ID NO: 1789 - DNA, 40 bp, Artificial Sequence
  DFor_85_CGTACT-G_ov
  modified_base 1: /mod_base="OTHER" /note="5'-phosphorylation"
gcgtacttcgtcggcagcgtcagatgtgtataagagacag

SEQ ID NO: 1790 - DNA, 40 bp, Artificial Sequence
  DFor_86_TCGGAT-G_ov
  modified_base 1: /mod_base="OTHER" /note="5'-phosphorylation"
gtcggattcgtcggcagcgtcagatgtgtataagagacag

SEQ ID NO: 1791 - DNA, 40 bp, Artificial Sequence
  DFor_87_TCCCAT-G_ov
  modified_base 1: /mod_base="OTHER" /note="5'-phosphorylation"
gtcccattcgtcggcagcgtcagatgtgtataagagacag

SEQ ID NO: 1792 - DNA, 40 bp, Artificial Sequence
  DFor_88_TTGCAC-G_ov
  modified_base 1: /mod_base="OTHER" /note="5'-phosphorylation"
gttgcactcgtcggcagcgtcagatgtgtataagagacag

SEQ ID NO: 1793 - DNA, 40 bp, Artificial Sequence
  DFor_89_TTCCTC-G_ov
  modified_base 1: /mod_base="OTHER" /note="5'-phosphorylation"
gttcctctcgtcggcagcgtcagatgtgtataagagacag

SEQ ID NO: 1794 - DNA, 40 bp, Artificial Sequence
  DFor_90_TACCTG-G_ov
  modified_base 1: /mod_base="OTHER" /note="5'-phosphorylation"
gtacctgtcgtcggcagcgtcagatgtgtataagagacag

SEQ ID NO: 1795 - DNA, 40 bp, Artificial Sequence
  DFor_91_AGAGTC-G_ov
  modified_base 1: /mod_base="OTHER" /note="5'-phosphorylation"
gagagtctcgtcggcagcgtcagatgtgtataagagacag

SEQ ID NO: 1796 - DNA, 40 bp, Artificial Sequence
  DFor_92_AGGACT-G_ov
  modified_base 1: /mod_base="OTHER" /note="5'-phosphorylation"
gaggacttcgtcggcagcgtcagatgtgtataagagacag

SEQ ID NO: 1797 - DNA, 40 bp, Artificial Sequence
  DFor_93_GGCTTA-G_ov
  modified_base 1: /mod_base="OTHER" /note="5'-phosphorylation"
gggcttatcgtcggcagcgtcagatgtgtataagagacag

SEQ ID NO: 1798 - DNA, 40 bp, Artificial Sequence
  DFor_94_GGCTAT-G_ov
  modified_base 1: /mod_base="OTHER" /note="5'-phosphorylation"
gggctattcgtcggcagcgtcagatgtgtataagagacag

SEQ ID NO: 1799 - DNA, 40 bp, Artificial Sequence
  DFor_95_CGGTTA-G_ov
  modified_base 1: /mod_base="OTHER" /note="5'-phosphorylation"
gcggttatcgtcggcagcgtcagatgtgtataagagacag

SEQ ID NO: 1800 - DNA, 40 bp, Artificial Sequence
  DFor_96_TGGCAT-G_ov
  modified_base 1: /mod_base="OTHER" /note="5'-phosphorylation"
gtggcattcgtcggcagcgtcagatgtgtataagagacag

SEQ ID NO: 1801 - DNA, 40 bp, Artificial Sequence
  DFor_1_GTTTCC-A_ov
  modified_base 1: /mod_base="OTHER" /note="5'-phosphorylation"
agtttcctcgtcggcagcgtcagatgtgtataagagacag

SEQ ID NO: 1802 - DNA, 40 bp, Artificial Sequence
  DFor_2_GGTGTT-A_ov
  modified_base 1: /mod_base="OTHER" /note="5'-phosphorylation"
aggtgtttcgtcggcagcgtcagatgtgtataagagacag

SEQ ID NO: 1803 - DNA, 40 bp, Artificial Sequence
  DFor_3_CTCGAT-A_ov
  modified_base 1: /mod_base="OTHER" /note="5'-phosphorylation"
actcgattcgtcggcagcgtcagatgtgtataagagacag

SEQ ID NO: 1804 - DNA, 40 bp, Artificial Sequence
  DFor_4_AAGGAG-A_ov
  modified_base 1: /mod_base="OTHER" /note="5'-phosphorylation"
aaaggagtcgtcggcagcgtcagatgtgtataagagacag

SEQ ID NO: 1805 - DNA, 40 bp, Artificial Sequence
  DFor_5_AACAGG-A_ov
  modified_base 1: /mod_base="OTHER" /note="5'-phosphorylation"
aaacaggtcgtcggcagcgtcagatgtgtataagagacag

SEQ ID NO: 1806 - DNA, 40 bp, Artificial Sequence
  DFor_6_AAACCG-A_ov
  modified_base 1: /mod_base="OTHER" /note="5'-phosphorylation"
aaaaccgtcgtcggcagcgtcagatgtgtataagagacag

SEQ ID NO: 1807 - DNA, 40 bp, Artificial Sequence
  DFor_7_AACCAC-A_ov
  modified_base 1: /mod_base="OTHER" /note="5'-phosphorylation"
aaaccactcgtcggcagcgtcagatgtgtataagagacag

SEQ ID NO: 1808 - DNA, 40 bp, Artificial Sequence
  DFor_8_AAAGGC-A_ov
  modified_base 1: /mod_base="OTHER" /note="5'-phosphorylation"
aaaaggctcgtcggcagcgtcagatgtgtataagagacag

SEQ ID NO: 1809 - DNA, 40 bp, Artificial Sequence
  DFor_9_AAGACC-A_ov
  modified_base 1: /mod_base="OTHER" /note="5'-phosphorylation"
aaagacctcgtcggcagcgtcagatgtgtataagagacag

SEQ ID NO: 1810 - DNA, 40 bp, Artificial Sequence
  DFor_10_AAGCGT-A_ov
  modified_base 1: /mod_base="OTHER" /note="5'-phosphorylation"
aaagcgttcgtcggcagcgtcagatgtgtataagagacag

SEQ ID NO: 1811 - DNA, 40 bp, Artificial Sequence
  DFor_11_AACGCT-A_ov
  modified_base 1: /mod_base="OTHER" /note="5'-phosphorylation"
aaacgcttcgtcggcagcgtcagatgtgtataagagacag

SEQ ID NO: 1812 - DNA, 40 bp, Artificial Sequence
  DFor_12_GACGAA-A_ov
  modified_base 1: /mod_base="OTHER" /note="5'-phosphorylation"
agacgaatcgtcggcagcgtcagatgtgtataagagacag

SEQ ID NO: 1813 - DNA, 40 bp, Artificial Sequence
  DFor_13_GAGAGA-A_ov
  modified_base 1: /mod_base="OTHER" /note="5'-phosphorylation"
agagagatcgtcggcagcgtcagatgtgtataagagacag

SEQ ID NO: 1814 - DNA, 40 bp, Artificial Sequence
  DFor_14_GATCCA-A_ov
  modified_base 1: /mod_base="OTHER" /note="5'-phosphorylation"
agatccatcgtcggcagcgtcagatgtgtataagagacag

SEQ ID NO: 1815 - DNA, 40 bp, Artificial Sequence
  DFor_15_GAAGTG-A_ov
  modified_base 1: /mod_base="OTHER" /note="5'-phosphorylation"
agaagtgtcgtcggcagcgtcagatgtgtataagagacag

SEQ ID NO: 1816 - DNA, 40 bp, Artificial Sequence
  DFor_16_GAGTAC-A_ov
  modified_base 1: /mod_base="OTHER" /note="5'-phosphorylation"
agagtactcgtcggcagcgtcagatgtgtataagagacag

SEQ ID NO: 1817 - DNA, 40 bp, Artificial Sequence
  DFor_17_GACATC-A_ov
  modified_base 1: /mod_base="OTHER" /note="5'-phosphorylation"
agacatctcgtcggcagcgtcagatgtgtataagagacag

SEQ ID NO: 1818 - DNA, 40 bp, Artificial Sequence
  DFor_18_GACTGT-A_ov
  modified_base 1: /mod_base="OTHER" /note="5'-phosphorylation"
agactgttcgtcggcagcgtcagatgtgtataagagacag

SEQ ID NO: 1819 - DNA, 40 bp, Artificial Sequence
  DFor_19_CAGCAA-A_ov
  modified_base 1: /mod_base="OTHER" /note="5'-phosphorylation"
acagcaatcgtcggcagcgtcagatgtgtataagagacag

SEQ ID NO: 1820 - DNA, 40 bp, Artificial Sequence
  DFor_20_CATGGA-A_ov
  modified_base 1: /mod_base="OTHER" /note="5'-phosphorylation"
acatggatcgtcggcagcgtcagatgtgtataagagacag

SEQ ID NO: 1821 - DNA, 40 bp, Artificial Sequence
  DFor_21_CACACA-A_ov
  modified_base 1: /mod_base="OTHER" /note="5'-phosphorylation"
acacacatcgtcggcagcgtcagatgtgtataagagacag

SEQ ID NO: 1822 - DNA, 40 bp, Artificial Sequence
  DFor_22_CACTAG-A_ov
  modified_base 1: /mod_base="OTHER" /note="5'-phosphorylation"
acactagtcgtcggcagcgtcagatgtgtataagagacag

SEQ ID NO: 1823 - DNA, 40 bp, Artificial Sequence
  DFor_23_CAGATG-A_ov
  modified_base 1: /mod_base="OTHER" /note="5'-phosphorylation"
acagatgtcgtcggcagcgtcagatgtgtataagagacag

SEQ ID NO: 1824 - DNA, 40 bp, Artificial Sequence
  DFor_24_CAACTC-A_ov
  modified_base 1: /mod_base="OTHER" /note="5'-phosphorylation"
acaactctcgtcggcagcgtcagatgtgtataagagacag

SEQ ID NO: 1825 - DNA, 40 bp, Artificial Sequence
  DFor_25_CAGTCT-A_ov
  modified_base 1: /mod_base="OTHER" /note="5'-phosphorylation"
acagtcttcgtcggcagcgtcagatgtgtataagagacag

SEQ ID NO: 1826 - DNA, 40 bp, Artificial Sequence
  DFor_26_TACCGA-A_ov
  modified_base 1: /mod_base="OTHER" /note="5'-phosphorylation"
ataccgatcgtcggcagcgtcagatgtgtataagagacag

SEQ ID NO: 1827 - DNA, 40 bp, Artificial Sequence
  DFor_27_TAGGCA-A_ov
  modified_base 1: /mod_base="OTHER" /note="5'-phosphorylation"
ataggcatcgtcggcagcgtcagatgtgtataagagacag

SEQ ID NO: 1828 - DNA, 40 bp, Artificial Sequence
  DFor_28_TAGTGG-A_ov
  modified_base 1: /mod_base="OTHER" /note="5'-phosphorylation"
atagtggtcgtcggcagcgtcagatgtgtataagagacag

SEQ ID NO: 1829 - DNA, 40 bp, Artificial Sequence
  DFor_29_TACTCC-A_ov
  modified_base 1: /mod_base="OTHER" /note="5'-phosphorylation"
atactcctcgtcggcagcgtcagatgtgtataagagacag

SEQ ID NO: 1830 - DNA, 40 bp, Artificial Sequence
  DFor_30_AGACGA-A_ov
  modified_base 1: /mod_base="OTHER" /note="5'-phosphorylation"
aagacgatcgtcggcagcgtcagatgtgtataagagacag

SEQ ID NO: 1831 - DNA, 40 bp, Artificial Sequence
  DFor_31_AGTGCA-A_ov
  modified_base 1: /mod_base="OTHER" /note="5'-phosphorylation"
aagtgcatcgtcggcagcgtcagatgtgtataagagacag

SEQ ID NO: 1832 - DNA, 40 bp, Artificial Sequence
  DFor_32_AGTCAG-A_ov
  modified_base 1: /mod_base="OTHER" /note="5'-phosphorylation"
aagtcagtcgtcggcagcgtcagatgtgtataagagacag

SEQ ID NO: 1833 - DNA, 40 bp, Artificial Sequence
  DFor_33_AGGTTG-A_ov
  modified_base 1: /mod_base="OTHER" /note="5'-phosphorylation"
aaggttgtcgtcggcagcgtcagatgtgtataagagacag

SEQ ID NO: 1834 - DNA, 40 bp, Artificial Sequence
  DFor_34_AGTAGC-A_ov
  modified_base 1: /mod_base="OTHER" /note="5'-phosphorylation"
aagtagctcgtcggcagcgtcagatgtgtataagagacag

SEQ ID NO: 1835 - DNA, 40 bp, Artificial Sequence
  DFor_35_AGATCC-A_ov
  modified_base 1: /mod_base="OTHER" /note="5'-phosphorylation"
aagatcctcgtcggcagcgtcagatgtgtataagagacag

SEQ ID NO: 1836 - DNA, 40 bp, Artificial Sequence
  DFor_36_AGCCTT-A_ov
  modified_base 1: /mod_base="OTHER" /note="5'-phosphorylation"
aagcctttcgtcggcagcgtcagatgtgtataagagacag

SEQ ID NO: 1837 - DNA, 40 bp, Artificial Sequence
  DFor_37_GGTTGA-A_ov
  modified_base 1: /mod_base="OTHER" /note="5'-phosphorylation"
aggttgatcgtcggcagcgtcagatgtgtataagagacag

SEQ ID NO: 1838 - DNA, 40 bp, Artificial Sequence
  DFor_38_GGAACA-A_ov
  modified_base 1: /mod_base="OTHER" /note="5'-phosphorylation"
aggaacatcgtcggcagcgtcagatgtgtataagagacag

SEQ ID NO: 1839 - DNA, 40 bp, Artificial Sequence
  DFor_39_GGGAAT-A_ov
  modified_base 1: /mod_base="OTHER" /note="5'-phosphorylation"
agggaattcgtcggcagcgtcagatgtgtataagagacag

SEQ ID NO: 1840 - DNA, 40 bp, Artificial Sequence
  DFor_40_CGAGAA-A_ov
  modified_base 1: /mod_base="OTHER" /note="5'-phosphorylation"
acgagaatcgtcggcagcgtcagatgtgtataagagacag

SEQ ID NO: 1841 - DNA, 40 bp, Artificial Sequence
  DFor_41_CGTCTA-A_ov
  modified_base 1: /mod_base="OTHER" /note="5'-phosphorylation"
acgtctatcgtcggcagcgtcagatgtgtataagagacag

SEQ ID NO: 1842 - DNA, 40 bp, Artificial Sequence
  DFor_42_CGTTAC-A_ov
  modified_base 1: /mod_base="OTHER" /note="5'-phosphorylation"
acgttactcgtcggcagcgtcagatgtgtataagagacag

SEQ ID NO: 1843 - DNA, 40 bp, Artificial Sequence
  DFor_43_CGAAGT-A_ov
  modified_base 1: /mod_base="OTHER" /note="5'-phosphorylation"
acgaagttcgtcggcagcgtcagatgtgtataagagacag

SEQ ID NO: 1844 - DNA, 40 bp, Artificial Sequence
  DFor_44_TGCGTA-A_ov
  modified_base 1: /mod_base="OTHER" /note="5'-phosphorylation"
atgcgtatcgtcggcagcgtcagatgtgtataagagacag

SEQ ID NO: 1845 - DNA, 40 bp, Artificial Sequence
  DFor_45_TGCAAG-A_ov
  modified_base 1: /mod_base="OTHER" /note="5'-phosphorylation"
atgcaagtcgtcggcagcgtcagatgtgtataagagacag

SEQ ID NO: 1846 - DNA, 40 bp, Artificial Sequence
  DFor_46_TGTTCG-A_ov
  modified_base 1: /mod_base="OTHER" /note="5'-phosphorylation"
atgttcgtcgtcggcagcgtcagatgtgtataagagacag

SEQ ID NO: 1847 - DNA, 40 bp, Artificial Sequence
  DFor_47_TGACTG-A_ov
  modified_base 1: /mod_base="OTHER" /note="5'-phosphorylation"
atgactgtcgtcggcagcgtcagatgtgtataagagacag

SEQ ID NO: 1848 - DNA, 40 bp, Artificial Sequence
  DFor_48_TGGATC-A_ov
  modified_base 1: /mod_base="OTHER" /note="5'-phosphorylation"
atggatctcgtcggcagcgtcagatgtgtataagagacag

SEQ ID NO: 1849 - DNA, 40 bp, Artificial Sequence
  DFor_49_TGTCGT-A_ov
  modified_base 1: /mod_base="OTHER" /note="5'-phosphorylation"
atgtcgttcgtcggcagcgtcagatgtgtataagagacag

SEQ ID NO: 1850 - DNA, 40 bp, Artificial Sequence
  DFor_50_TGAGCT-A_ov
  modified_base 1: /mod_base="OTHER" /note="5'-phosphorylation"
atgagcttcgtcggcagcgtcagatgtgtataagagacag

SEQ ID NO: 1851 - DNA, 40 bp, Artificial Sequence
  DFor_51_ACGTGA-A_ov
  modified_base 1: /mod_base="OTHER" /note="5'-phosphorylation"
aacgtgatcgtcggcagcgtcagatgtgtataagagacag

SEQ ID NO: 1852 - DNA, 40 bp, Artificial Sequence
  DFor_52_ACTACG-A_ov
  modified_base 1: /mod_base="OTHER" /note="5'-phosphorylation"
aactacgtcgtcggcagcgtcagatgtgtataagagacag

SEQ ID NO: 1853 - DNA, 40 bp, Artificial Sequence
  DFor_53_ACTGAC-A_ov
  modified_base 1: /mod_base="OTHER" /note="5'-phosphorylation"
aactgactcgtcggcagcgtcagatgtgtataagagacag

SEQ ID NO: 1854 - DNA, 40 bp, Artificial Sequence
  DFor_54_ACCTTC-A_ov
  modified_base 1: /mod_base="OTHER" /note="5'-phosphorylation"
aaccttctcgtcggcagcgtcagatgtgtataagagacag

SEQ ID NO: 1855 - DNA, 40 bp, Artificial Sequence
  DFor_55_ACGGTT-A_ov
  modified_base 1: /mod_base="OTHER" /note="5'-phosphorylation"
aacggtttcgtcggcagcgtcagatgtgtataagagacag

SEQ ID NO: 1856 - DNA, 40 bp, Artificial Sequence
  DFor_56_GCACAA-A_ov
  modified_base 1: /mod_base="OTHER" /note="5'-phosphorylation"
agcacaatcgtcggcagcgtcagatgtgtataagagacag

SEQ ID NO: 1857 - DNA, 40 bp, Artificial Sequence
  DFor_57_GCTTAG-A_ov
  modified_base 1: /mod_base="OTHER" /note="5'-phosphorylation"
agcttagtcgtcggcagcgtcagatgtgtataagagacag

SEQ ID NO: 1858 - DNA, 40 bp, Artificial Sequence
  DFor_58_GCTAGT-A_ov
  modified_base 1: /mod_base="OTHER" /note="5'-phosphorylation"
agctagttcgtcggcagcgtcagatgtgtataagagacag

SEQ ID NO: 1859 - DNA, 40 bp, Artificial Sequence
  DFor_59_GCATCT-A_ov
  modified_base 1: /mod_base="OTHER" /note="5'-phosphorylation"
agcatcttcgtcggcagcgtcagatgtgtataagagacag

SEQ ID NO: 1860 - DNA, 40 bp, Artificial Sequence
  DFor_60_CCTTCA-A_ov
  modified_base 1: /mod_base="OTHER" /note="5'-phosphorylation"
accttcatcgtcggcagcgtcagatgtgtataagagacag

SEQ ID NO: 1861 - DNA, 40 bp, Artificial Sequence
  DFor_61_CCATTG-A_ov
  modified_base 1: /mod_base="OTHER" /note="5'-phosphorylation"
accattgtcgtcggcagcgtcagatgtgtataagagacag

SEQ ID NO: 1862 - DNA, 40 bp, Artificial Sequence
  DFor_62_CCTCAT-A_ov
  modified_base 1: /mod_base="OTHER" /note="5'-phosphorylation"
acctcattcgtcggcagcgtcagatgtgtataagagacag

SEQ ID NO: 1863 - DNA, 40 bp, Artificial Sequence
  DFor_63_CCCATT-A_ov
  modified_base 1: /mod_base="OTHER" /note="5'-phosphorylation"
acccatttcgtcggcagcgtcagatgtgtataagagacag

SEQ ID NO: 1864 - DNA, 40 bp, Artificial Sequence
  DFor_64_TCAGGA-A_ov
  modified_base 1: /mod_base="OTHER" /note="5'-phosphorylation"
atcaggatcgtcggcagcgtcagatgtgtataagagacag

SEQ ID NO: 1865 - DNA, 40 bp, Artificial Sequence
  DFor_65_TCGCTA-A_ov
  modified_base 1: /mod_base="OTHER" /note="5'-phosphorylation"
atcgctatcgtcggcagcgtcagatgtgtataagagacag

SEQ ID NO: 1866 - DNA, 40 bp, Artificial Sequence
  DFor_66_TCTGTG-A_ov
  modified_base 1: /mod_base="OTHER" /note="5'-phosphorylation"
atctgtgtcgtcggcagcgtcagatgtgtataagagacag

SEQ ID NO: 1867 - DNA, 40 bp, Artificial Sequence
  DFor_67_TCTTGC-A_ov
  modified_base 1: /mod_base="OTHER" /note="5'-phosphorylation"
atcttgctcgtcggcagcgtcagatgtgtataagagacag

SEQ ID NO: 1868 - DNA, 40 bp, Artificial Sequence
  DFor_68_TCAACC-A_ov
  modified_base 1: /mod_base="OTHER" /note="5'-phosphorylation"
atcaacctcgtcggcagcgtcagatgtgtataagagacag

SEQ ID NO: 1869 - DNA, 40 bp, Artificial Sequence
  DFor_69_ATCGGA-A_ov
  modified_base 1: /mod_base="OTHER" /note="5'-phosphorylation"
aatcggatcgtcggcagcgtcagatgtgtataagagacag

SEQ ID NO: 1870 - DNA, 40 bp, Artificial Sequence
  DFor_70_ATGCCA-A_ov
  modified_base 1: /mod_base="OTHER" /note="5'-phosphorylation"
aatgccatcgtcggcagcgtcagatgtgtataagagacag

SEQ ID NO: 1871 - DNA, 40 bp, Artificial Sequence
  DFor_71_ATCTCG-A_ov
  modified_base 1: /mod_base="OTHER" /note="5'-phosphorylation"
aatctcgtcgtcggcagcgtcagatgtgtataagagacag

SEQ ID NO: 1872 - DNA, 40 bp, Artificial Sequence
  DFor_72_GTGGTA-A_ov
  modified_base 1: /mod_base="OTHER" /note="5'-phosphorylation"
agtggtatcgtcggcagcgtcagatgtgtataagagacag

SEQ ID NO: 1873 - DNA, 40 bp, Artificial Sequence
  DFor_73_GTTCTG-A_ov
  modified_base 1: /mod_base="OTHER" /note="5'-phosphorylation"
agttctgtcgtcggcagcgtcagatgtgtataagagacag

SEQ ID NO: 1874 - DNA, 40 bp, Artificial Sequence
  DFor_74_GTAGAC-A_ov
  modified_base 1: /mod_base="OTHER" /note="5'-phosphorylation"
agtagactcgtcggcagcgtcagatgtgtataagagacag

SEQ ID NO: 1875 - DNA, 40 bp, Artificial Sequence
  DFor_75_GTACGT-A_ov
  modified_base 1: /mod_base="OTHER" /note="5'-phosphorylation"
agtacgttcgtcggcagcgtcagatgtgtataagagacag

SEQ ID NO: 1876 - DNA, 40 bp, Artificial Sequence
  DFor_76_GTCACT-A_ov
  modified_base 1: /mod_base="OTHER" /note="5'-phosphorylation"
agtcacttcgtcggcagcgtcagatgtgtataagagacag

SEQ ID NO: 1877 - DNA, 40 bp, Artificial Sequence
  DFor_77_CTACAG-A_ov
  modified_base 1: /mod_base="OTHER" /note="5'-phosphorylation"
actacagtcgtcggcagcgtcagatgtgtataagagacag

SEQ ID NO: 1878 - DNA, 40 bp, Artificial Sequence
  DFor_78_CTTAGG-A_ov
  modified_base 1: /mod_base="OTHER" /note="5'-phosphorylation"
acttaggtcgtcggcagcgtcagatgtgtataagagacag

SEQ ID NO: 1879 - DNA, 40 bp, Artificial Sequence
  DFor_79_CTGAAC-A_ov
  modified_base 1: /mod_base="OTHER" /note="5'-phosphorylation"
actgaactcgtcggcagcgtcagatgtgtataagagacag

SEQ ID NO: 1880 - DNA, 40 bp, Artificial Sequence
  DFor_80_CTATGC-A_ov
  modified_base 1: /mod_base="OTHER" /note="5'-phosphorylation"
actatgctcgtcggcagcgtcagatgtgtataagagacag

SEQ ID NO: 1881 - DNA, 40 bp, Artificial Sequence
  DFor_81_CTTGTC-A_ov
  modified_base 1: /mod_base="OTHER" /note="5'-phosphorylation"
acttgtctcgtcggcagcgtcagatgtgtataagagacag

SEQ ID NO: 1882 - DNA, 40 bp, Artificial Sequence
  DFor_82_CTGCTT-A_ov
  modified_base 1: /mod_base="OTHER" /note="5'-phosphorylation"
actgctttcgtcggcagcgtcagatgtgtataagagacag

SEQ ID NO: 1883 - DNA, 40 bp, Artificial Sequence
  DFor_83_TTGACG-A_ov
  modified_base 1: /mod_base="OTHER" /note="5'-phosphorylation"
attgacgtcgtcggcagcgtcagatgtgtataagagacag

SEQ ID NO: 1884 - DNA, 40 bp, Artificial Sequence
  DFor_84_TTCAGC-A_ov
  modified_base 1: /mod_base="OTHER" /note="5'-phosphorylation"
attcagctcgtcggcagcgtcagatgtgtataagagacag

SEQ ID NO: 1885 - DNA, 40 bp, Artificial Sequence
  DFor_85_CGTACT-A_ov
  modified_base 1: /mod_base="OTHER" /note="5'-phosphorylation"
acgtacttcgtcggcagcgtcagatgtgtataagagacag

SEQ ID NO: 1886 - DNA, 40 bp, Artificial Sequence
  DFor_86_TCGGAT-A_ov
  modified_base 1: /mod_base="OTHER" /note="5'-phosphorylation"
atcggattcgtcggcagcgtcagatgtgtataagagacag

SEQ ID NO: 1887 - DNA, 40 bp, Artificial Sequence
  DFor_87_TCCCAT-A_ov
  modified_base 1: /mod_base="OTHER" /note="5'-phosphorylation"
atcccattcgtcggcagcgtcagatgtgtataagagacag

SEQ ID NO: 1888 - DNA, 40 bp, Artificial Sequence
  DFor_88_TTGCAC-A_ov
  modified_base 1: /mod_base="OTHER" /note="5'-phosphorylation"
attgcactcgtcggcagcgtcagatgtgtataagagacag

SEQ ID NO: 1889 - DNA, 40 bp, Artificial Sequence
  DFor_89_TTCCTC-A_ov
  modified_base 1: /mod_base="OTHER" /note="5'-phosphorylation"
attcctctcgtcggcagcgtcagatgtgtataagagacag

SEQ ID NO: 1890 - DNA, 40 bp, Artificial Sequence
  DFor_90_TACCTG-A_ov
  modified_base 1: /mod_base="OTHER" /note="5'-phosphorylation"
atacctgtcgtcggcagcgtcagatgtgtataagagacag

SEQ ID NO: 1891 - DNA, 40 bp, Artificial Sequence
  DFor_91_AGAGTC-A_ov
  modified_base 1: /mod_base="OTHER" /note="5'-phosphorylation"
aagagtctcgtcggcagcgtcagatgtgtataagagacag

SEQ ID NO: 1892 - DNA, 40 bp, Artificial Sequence
  DFor_92_AGGACT-A_ov
  modified_base 1: /mod_base="OTHER" /note="5'-phosphorylation"
aaggacttcgtcggcagcgtcagatgtgtataagagacag

SEQ ID NO: 1893 - DNA, 40 bp, Artificial Sequence
  DFor_93_GGCTTA-A_ov
  modified_base 1: /mod_base="OTHER" /note="5'-phosphorylation"
aggcttatcgtcggcagcgtcagatgtgtataagagacag

SEQ ID NO: 1894 - DNA, 40 bp, Artificial Sequence
  DFor_94_GGCTAT-A_ov
  modified_base 1: /mod_base="OTHER" /note="5'-phosphorylation"
aggctattcgtcggcagcgtcagatgtgtataagagacag

SEQ ID NO: 1895 - DNA, 40 bp, Artificial Sequence
  DFor_95_CGGTTA-A_ov
  modified_base 1: /mod_base="OTHER" /note="5'-phosphorylation"
acggttatcgtcggcagcgtcagatgtgtataagagacag

SEQ ID NO: 1896 - DNA, 40 bp, Artificial Sequence
  DFor_96_TGGCAT-A_ov
  modified_base 1: /mod_base="OTHER" /note="5'-phosphorylation"
atggcattcgtcggcagcgtcagatgtgtataagagacag

SEQ ID NO: 1897 - DNA, 40 bp, Artificial Sequence
  DFor_1_GTTTCC-C_ov
  modified_base 1: /mod_base="OTHER" /note="5'-phosphorylation"
cgtttcctcgtcggcagcgtcagatgtgtataagagacag

SEQ ID NO: 1898 - DNA, 40 bp, Artificial Sequence
  DFor_2_GGTGTT-C_ov
  modified_base 1: /mod_base="OTHER" /note="5'-phosphorylation"
cggtgtttcgtcggcagcgtcagatgtgtataagagacag

SEQ ID NO: 1899 - DNA, 40 bp, Artificial Sequence
  DFor_3_CTCGAT-C_ov
  modified_base 1: /mod_base="OTHER" /note="5'-phosphorylation"
cctcgattcgtcggcagcgtcagatgtgtataagagacag

SEQ ID NO: 1900 - DNA, 40 bp, Artificial Sequence
  DFor_4_AAGGAG-C_ov
  modified_base 1: /mod_base="OTHER" /note="5'-phosphorylation"
caaggagtcgtcggcagcgtcagatgtgtataagagacag

SEQ ID NO: 1901 - DNA, 40 bp, Artificial Sequence
  DFor_5_AACAGG-C_ov
  modified_base 1: /mod_base="OTHER" /note="5'-phosphorylation"
caacaggtcgtcggcagcgtcagatgtgtataagagacag

SEQ ID NO: 1902 - DNA, 40 bp, Artificial Sequence
  DFor_6_AAACCG-C_ov
  modified_base 1: /mod_base="OTHER" /note="5'-phosphorylation"
caaaccgtcgtcggcagcgtcagatgtgtataagagacag

SEQ ID NO: 1903 - DNA, 40 bp, Artificial Sequence
  DFor_7_AACCAC-C_ov
  modified_base 1: /mod_base="OTHER" /note="5'-phosphorylation"
caaccactcgtcggcagcgtcagatgtgtataagagacag

SEQ ID NO: 1904 - DNA, 40 bp, Artificial Sequence
  DFor_8_AAAGGC-C_ov
  modified_base 1: /mod_base="OTHER" /note="5'-phosphorylation"
caaaggctcgtcggcagcgtcagatgtgtataagagacag

SEQ ID NO: 1905 - DNA, 40 bp, Artificial Sequence
  DFor_9_AAGACC-C_ov
  modified_base 1: /mod_base="OTHER" /note="5'-phosphorylation"
caagacctcgtcggcagcgtcagatgtgtataagagacag

SEQ ID NO: 1906 - DNA, 40 bp, Artificial Sequence
  DFor_10_AAGCGT-C_ov
  modified_base 1: /mod_base="OTHER" /note="5'-phosphorylation"
caagcgttcgtcggcagcgtcagatgtgtataagagacag

SEQ ID NO: 1907 - DNA, 40 bp, Artificial Sequence
  DFor_11_AACGCT-C_ov
  modified_base 1: /mod_base="OTHER" /note="5'-phosphorylation"
caacgcttcgtcggcagcgtcagatgtgtataagagacag

SEQ ID NO: 1908 - DNA, 40 bp, Artificial Sequence
  DFor_12_GACGAA-C_ov
  modified_base 1: /mod_base="OTHER" /note="5'-phosphorylation"
cgacgaatcgtcggcagcgtcagatgtgtataagagacag

SEQ ID NO: 1909 - DNA, 40 bp, Artificial Sequence
  DFor_13_GAGAGA-C_ov
  modified_base 1: /mod_base="OTHER" /note="5'-phosphorylation"
cgagagatcgtcggcagcgtcagatgtgtataagagacag

SEQ ID NO: 1910 - DNA, 40 bp, Artificial Sequence
  DFor_14_GATCCA-C_ov
  modified_base 1: /mod_base="OTHER" /note="5'-phosphorylation"
cgatccatcgtcggcagcgtcagatgtgtataagagacag

SEQ ID NO: 1911 - DNA, 40 bp, Artificial Sequence
  DFor_15_GAAGTG-C_ov
  modified_base 1: /mod_base="OTHER" /note="5'-phosphorylation"
cgaagtgtcgtcggcagcgtcagatgtgtataagagacag

SEQ ID NO: 1912 - DNA, 40 bp, Artificial Sequence
  DFor_16_GAGTAC-C_ov
  modified_base 1: /mod_base="OTHER" /note="5'-phosphorylation"
cgagtactcgtcggcagcgtcagatgtgtataagagacag

SEQ ID NO: 1913 - DNA, 40 bp, Artificial Sequence
  DFor_17_GACATC-C_ov
  modified_base 1: /mod_base="OTHER" /note="5'-phosphorylation"
cgacatctcgtcggcagcgtcagatgtgtataagagacag

SEQ ID NO: 1914 - DNA, 40 bp, Artificial Sequence
  DFor_18_GACTGT-C_ov
  modified_base 1: /mod_base="OTHER" /note="5'-phosphorylation"
cgactgttcgtcggcagcgtcagatgtgtataagagacag

SEQ ID NO: 1915 - DNA, 40 bp, Artificial Sequence
  DFor_19_CAGCAA-C_ov
  modified_base 1: /mod_base="OTHER" /note="5'-phosphorylation"
ccagcaatcgtcggcagcgtcagatgtgtataagagacag

SEQ ID NO: 1916 - DNA, 40 bp, Artificial Sequence
  DFor_20_CATGGA-C_ov
  modified_base 1: /mod_base="OTHER" /note="5'-phosphorylation"
ccatggatcgtcggcagcgtcagatgtgtataagagacag

SEQ ID NO: 1917 - DNA, 40 bp, Artificial Sequence
  DFor_21_CACACA-C_ov
  modified_base 1: /mod_base="OTHER" /note="5'-phosphorylation"
ccacacatcgtcggcagcgtcagatgtgtataagagacag

SEQ ID NO: 1918 - DNA, 40 bp, Artificial Sequence
  DFor_22_CACTAG-C_ov
  modified_base 1: /mod_base="OTHER" /note="5'-phosphorylation"
ccactagtcgtcggcagcgtcagatgtgtataagagacag

SEQ ID NO: 1919 - DNA, 40 bp, Artificial Sequence
  DFor_23_CAGATG-C_ov
  modified_base 1: /mod_base="OTHER" /note="5'-phosphorylation"
ccagatgtcgtcggcagcgtcagatgtgtataagagacag

SEQ ID NO: 1920 - DNA, 40 bp, Artificial Sequence
  DFor_24_CAACTC-C_ov
  modified_base 1: /mod_base="OTHER" /note="5'-phosphorylation"
ccaactctcgtcggcagcgtcagatgtgtataagagacag

SEQ ID NO: 1921 - DNA, 40 bp, Artificial Sequence
  DFor_25_CAGTCT-C_ov
  modified_base 1: /mod_base="OTHER" /note="5'-phosphorylation"
ccagtcttcgtcggcagcgtcagatgtgtataagagacag

SEQ ID NO: 1922 - DNA, 40 bp, Artificial Sequence
  DFor_26_TACCGA-C_ov
  modified_base 1: /mod_base="OTHER" /note="5'-phosphorylation"
ctaccgatcgtcggcagcgtcagatgtgtataagagacag

SEQ ID NO: 1923 - DNA, 40 bp, Artificial Sequence
  DFor_27_TAGGCA-C_ov
  modified_base 1: /mod_base="OTHER" /note="5'-phosphorylation"
ctaggcatcgtcggcagcgtcagatgtgtataagagacag

SEQ ID NO: 1924 - DNA, 40 bp, Artificial Sequence
  DFor_28_TAGTGG-C_ov
  modified_base 1: /mod_base="OTHER" /note="5'-phosphorylation"
ctagtggtcgtcggcagcgtcagatgtgtataagagacag

SEQ ID NO: 1925 - DNA, 40 bp, Artificial Sequence
  DFor_29_TACTCC-C_ov
  modified_base 1: /mod_base="OTHER" /note="5'-phosphorylation"
ctactcctcgtcggcagcgtcagatgtgtataagagacag

SEQ ID NO: 1926 - DNA, 40 bp, Artificial Sequence
  DFor_30_AGACGA-C_ov
  modified_base 1: /mod_base="OTHER" /note="5'-phosphorylation"
cagacgatcgtcggcagcgtcagatgtgtataagagacag

SEQ ID NO: 1927 - DNA, 40 bp, Artificial Sequence
  DFor_31_AGTGCA-C_ov
  modified_base 1: /mod_base="OTHER" /note="5'-phosphorylation"
cagtgcatcgtcggcagcgtcagatgtgtataagagacag

SEQ ID NO: 1928 - DNA, 40 bp, Artificial Sequence
  DFor_32_AGTCAG-C_ov
  modified_base 1: /mod_base="OTHER" /note="5'-phosphorylation"
cagtcagtcgtcggcagcgtcagatgtgtataagagacag

SEQ ID NO: 1929 - DNA, 40 bp, Artificial Sequence
  DFor_33_AGGTTG-C_ov
  modified_base 1: /mod_base="OTHER" /note="5'-phosphorylation"
caggttgtcgtcggcagcgtcagatgtgtataagagacag

SEQ ID NO: 1930 - DNA, 40 bp, Artificial Sequence
  DFor_34_AGTAGC-C_ov
  modified_base 1: /mod_base="OTHER" /note="5'-phosphorylation"
cagtagctcgtcggcagcgtcagatgtgtataagagacag

SEQ ID NO: 1931 - DNA, 40 bp, Artificial Sequence
  DFor_35_AGATCC-C_ov
  modified_base 1: /mod_base="OTHER" /note="5'-phosphorylation"
cagatcctcgtcggcagcgtcagatgtgtataagagacag

SEQ ID NO: 1932 - DNA, 40 bp, Artificial Sequence
  DFor_36_AGCCTT-C_ov
  modified_base 1: /mod_base="OTHER" /note="5'-phosphorylation"
cagcctttcgtcggcagcgtcagatgtgtataagagacag

SEQ ID NO: 1933 - DNA, 40 bp, Artificial Sequence
  DFor_37_GGTTGA-C_ov
  modified_base 1: /mod_base="OTHER" /note="5'-phosphorylation"
cggttgatcgtcggcagcgtcagatgtgtataagagacag

SEQ ID NO: 1934 - DNA, 40 bp, Artificial Sequence
  DFor_38_GGAACA-C_ov
  modified_base 1: /mod_base="OTHER" /note="5'-phosphorylation"
cggaacatcgtcggcagcgtcagatgtgtataagagacag

SEQ ID NO: 1935 - DNA, 40 bp, Artificial Sequence
  DFor_39_GGGAAT-C_ov
  modified_base 1: /mod_base="OTHER" /note="5'-phosphorylation"
cgggaattcgtcggcagcgtcagatgtgtataagagacag

SEQ ID NO: 1936 - DNA, 40 bp, Artificial Sequence
  DFor_40_CGAGAA-C_ov
  modified_base 1: /mod_base="OTHER" /note="5'-phosphorylation"
ccgagaatcgtcggcagcgtcagatgtgtataagagacag

SEQ ID NO: 1937 - DNA, 40 bp, Artificial Sequence
  DFor_41_CGTCTA-C_ov
  modified_base 1: /mod_base="OTHER" /note="5'-phosphorylation"
ccgtctatcgtcggcagcgtcagatgtgtataagagacag

SEQ ID NO: 1938 - DNA, 40 bp, Artificial Sequence
  DFor_42_CGTTAC-C_ov
  modified_base 1: /mod_base="OTHER" /note="5'-phosphorylation"
ccgttactcgtcggcagcgtcagatgtgtataagagacag

SEQ ID NO: 1939 - DNA, 40 bp, Artificial Sequence
  DFor_43_CGAAGT-C_ov
  modified_base 1: /mod_base="OTHER" /note="5'-phosphorylation"
ccgaagttcgtcggcagcgtcagatgtgtataagagacag

SEQ ID NO: 1940 - DNA, 40 bp, Artificial Sequence
  DFor_44_TGCGTA-C_ov
  modified_base 1: /mod_base="OTHER" /note="5'-phosphorylation"
ctgcgtatcgtcggcagcgtcagatgtgtataagagacag

SEQ ID NO: 1941 - DNA, 40 bp, Artificial Sequence
  DFor_45_TGCAAG-C_ov
  modified_base 1: /mod_base="OTHER" /note="5'-phosphorylation"
ctgcaagtcgtcggcagcgtcagatgtgtataagagacag

SEQ ID NO: 1942 - DNA, 40 bp, Artificial Sequence
  DFor_46_TGTTCG-C_ov
  modified_base 1: /mod_base="OTHER" /note="5'-phosphorylation"
ctgttcgtcgtcggcagcgtcagatgtgtataagagacag

SEQ ID NO: 1943 - DNA, 40 bp, Artificial Sequence
  DFor_47_TGACTG-C_ov
  modified_base 1: /mod_base="OTHER" /note="5'-phosphorylation"
ctgactgtcgtcggcagcgtcagatgtgtataagagacag

SEQ ID NO: 1944 - DNA, 40 bp, Artificial Sequence
  DFor_48_TGGATC-C_ov
  modified_base 1: /mod_base="OTHER" /note="5'-phosphorylation"
ctggatctcgtcggcagcgtcagatgtgtataagagacag

SEQ ID NO: 1945 - DNA, 40 bp, Artificial Sequence
  DFor_49_TGTCGT-C_ov
  modified_base 1: /mod_base="OTHER" /note="5'-phosphorylation"
ctgtcgttcgtcggcagcgtcagatgtgtataagagacag

SEQ ID NO: 1946 - DNA, 40 bp, Artificial Sequence
  DFor_50_TGAGCT-C_ov
  modified_base 1: /mod_base="OTHER" /note="5'-phosphorylation"
ctgagcttcgtcggcagcgtcagatgtgtataagagacag

SEQ ID NO: 1947 - DNA, 40 bp, Artificial Sequence
  DFor_51_ACGTGA-C_ov
  modified_base 1: /mod_base="OTHER" /note="5'-phosphorylation"
cacgtgatcgtcggcagcgtcagatgtgtataagagacag

SEQ ID NO: 1948 - DNA, 40 bp, Artificial Sequence
  DFor_52_ACTACG-C_ov
  modified_base 1: /mod_base="OTHER" /note="5'-phosphorylation"
cactacgtcgtcggcagcgtcagatgtgtataagagacag

SEQ ID NO: 1949 - DNA, 40 bp, Artificial Sequence
  DFor_53_ACTGAC-C_ov
  modified_base 1: /mod_base="OTHER" /note="5'-phosphorylation"
cactgactcgtcggcagcgtcagatgtgtataagagacag

SEQ ID NO: 1950 - DNA, 40 bp, Artificial Sequence
  DFor_54_ACCTTC-C_ov
  modified_base 1: /mod_base="OTHER" /note="5'-phosphorylation"
caccttctcgtcggcagcgtcagatgtgtataagagacag

SEQ ID NO: 1951 - DNA, 40 bp, Artificial Sequence
  DFor_55_ACGGTT-C_ov
  modified_base 1: /mod_base="OTHER" /note="5'-phosphorylation"
cacggtttcgtcggcagcgtcagatgtgtataagagacag

SEQ ID NO: 1952 - DNA, 40 bp, Artificial Sequence
  DFor_56_GCACAA-C_ov
  modified_base 1: /mod_base="OTHER" /note="5'-phosphorylation"
cgcacaatcgtcggcagcgtcagatgtgtataagagacag

SEQ ID NO: 1953 - DNA, 40 bp, Artificial Sequence
  DFor_57_GCTTAG-C_ov
  modified_base 1: /mod_base="OTHER" /note="5'-phosphorylation"
cgcttagtcgtcggcagcgtcagatgtgtataagagacag

SEQ ID NO: 1954 - DNA, 40 bp, Artificial Sequence
  DFor_58_GCTAGT-C_ov
  modified_base 1: /mod_base="OTHER" /note="5'-phosphorylation"
cgctagttcgtcggcagcgtcagatgtgtataagagacag

SEQ ID NO: 1955 - DNA, 40 bp, Artificial Sequence
  DFor_59_GCATCT-C_ov
  modified_base 1: /mod_base="OTHER" /note="5'-phosphorylation"
cgcatcttcgtcggcagcgtcagatgtgtataagagacag

SEQ ID NO: 1956 - DNA, 40 bp, Artificial Sequence
  DFor_60_CCTTCA-C_ov
  modified_base 1: /mod_base="OTHER" /note="5'-phosphorylation"
cccttcatcgtcggcagcgtcagatgtgtataagagacag

SEQ ID NO: 1957 - DNA, 40 bp, Artificial Sequence
  DFor_61_CCATTG-C_ov
  modified_base 1: /mod_base="OTHER" /note="5'-phosphorylation"
cccattgtcgtcggcagcgtcagatgtgtataagagacag

SEQ ID NO: 1958 - DNA, 40 bp, Artificial Sequence
  DFor_62_CCTCAT-C_ov
  modified_base 1: /mod_base="OTHER" /note="5'-phosphorylation"
ccctcattcgtcggcagcgtcagatgtgtataagagacag

SEQ ID NO: 1959 - DNA, 40 bp, Artificial Sequence
  DFor_63_CCCATT-C_ov
  modified_base 1: /mod_base="OTHER" /note="5'-phosphorylation"
ccccatttcgtcggcagcgtcagatgtgtataagagacag

SEQ ID NO: 1960 - DNA, 40 bp, Artificial Sequence
  DFor_64_TCAGGA-C_ov
  modified_base 1: /mod_base="OTHER" /note="5'-phosphorylation"
ctcaggatcgtcggcagcgtcagatgtgtataagagacag

SEQ ID NO: 1961 - DNA, 40 bp, Artificial Sequence
  DFor_65_TCGCTA-C_ov
  modified_base 1: /mod_base="OTHER" /note="5'-phosphorylation"
ctcgctatcgtcggcagcgtcagatgtgtataagagacag

SEQ ID NO: 1962 - DNA, 40 bp, Artificial Sequence
  DFor_66_TCTGTG-C_ov
  modified_base 1: /mod_base="OTHER" /note="5'-phosphorylation"
ctctgtgtcgtcggcagcgtcagatgtgtataagagacag

SEQ ID NO: 1963 - DNA, 40 bp, Artificial Sequence
  DFor_67_TCTTGC-C_ov
  modified_base 1: /mod_base="OTHER" /note="5'-phosphorylation"
ctcttgctcgtcggcagcgtcagatgtgtataagagacag

SEQ ID NO: 1964 - DNA, 40 bp, Artificial Sequence
  DFor_68_TCAACC-C_ov
  modified_base 1: /mod_base="OTHER" /note="5'-phosphorylation"
ctcaacctcgtcggcagcgtcagatgtgtataagagacag

SEQ ID NO: 1965 - DNA, 40 bp, Artificial Sequence
  DFor_69_ATCGGA-C_ov
  modified_base 1: /mod_base="OTHER" /note="5'-phosphorylation"
catcggatcgtcggcagcgtcagatgtgtataagagacag

SEQ ID NO: 1966 - DNA, 40 bp, Artificial Sequence
  DFor_70_ATGCCA-C_ov
  modified_base 1: /mod_base="OTHER" /note="5'-phosphorylation"
catgccatcgtcggcagcgtcagatgtgtataagagacag

SEQ ID NO: 1967 - DNA, 40 bp, Artificial Sequence
  DFor_71_ATCTCG-C_ov
  modified_base 1: /mod_base="OTHER" /note="5'-phosphorylation"
catctcgtcgtcggcagcgtcagatgtgtataagagacag

SEQ ID NO: 1968 - DNA, 40 bp, Artificial Sequence
  DFor_72_GTGGTA-C_ov
  modified_base 1: /mod_base="OTHER" /note="5'-phosphorylation"
cgtggtatcgtcggcagcgtcagatgtgtataagagacag

SEQ ID NO: 1969 - DNA, 40 bp, Artificial Sequence
  DFor_73_GTTCTG-C_ov
  modified_base 1: /mod_base="OTHER" /note="5'-phosphorylation"
cgttctgtcgtcggcagcgtcagatgtgtataagagacag

SEQ ID NO: 1970 - DNA, 40 bp, Artificial Sequence
  DFor_74_GTAGAC-C_ov
  modified_base 1: /mod_base="OTHER" /note="5'-phosphorylation"
cgtagactcgtcggcagcgtcagatgtgtataagagacag

SEQ ID NO: 1971 - DNA, 40 bp, Artificial Sequence
  DFor_75_GTACGT-C_ov
  modified_base 1: /mod_base="OTHER" /note="5'-phosphorylation"
cgtacgttcgtcggcagcgtcagatgtgtataagagacag

SEQ ID NO: 1972 - DNA, 40 bp, Artificial Sequence
  DFor_76_GTCACT-C_ov
  modified_base 1: /mod_base="OTHER" /note="5'-phosphorylation"
cgtcacttcgtcggcagcgtcagatgtgtataagagacag

SEQ ID NO: 1973 - DNA, 40 bp, Artificial Sequence
  DFor_77_CTACAG-C_ov
  modified_base 1: /mod_base="OTHER" /note="5'-phosphorylation"
cctacagtcgtcggcagcgtcagatgtgtataagagacag

SEQ ID NO: 1974 - DNA, 40 bp, Artificial Sequence
  DFor_78_CTTAGG-C_ov
  modified_base 1: /mod_base="OTHER" /note="5'-phosphorylation"
ccttaggtcgtcggcagcgtcagatgtgtataagagacag

SEQ ID NO: 1975 - DNA, 40 bp, Artificial Sequence
  DFor_79_CTGAAC-C_ov
  modified_base 1: /mod_base="OTHER" /note="5'-phosphorylation"
cctgaactcgtcggcagcgtcagatgtgtataagagacag

SEQ ID NO: 1976 - DNA, 40 bp, Artificial Sequence
  DFor_80_CTATGC-C_ov
  modified_base 1: /mod_base="OTHER" /note="5'-phosphorylation"
cctatgctcgtcggcagcgtcagatgtgtataagagacag

SEQ ID NO: 1977 - DNA, 40 bp, Artificial Sequence
  DFor_81_CTTGTC-C_ov
  modified_base 1: /mod_base="OTHER" /note="5'-phosphorylation"
ccttgtctcgtcggcagcgtcagatgtgtataagagacag

SEQ ID NO: 1978 - DNA, 40 bp, Artificial Sequence
  DFor_82_CTGCTT-C_ov
  modified_base 1: /mod_base="OTHER" /note="5'-phosphorylation"
cctgctttcgtcggcagcgtcagatgtgtataagagacag

SEQ ID NO: 1979 - DNA, 40 bp, Artificial Sequence
  DFor_83_TTGACG-C_ov
  modified_base 1: /mod_base="OTHER" /note="5'-phosphorylation"
cttgacgtcgtcggcagcgtcagatgtgtataagagacag

SEQ ID NO: 1980 - DNA, 40 bp, Artificial Sequence
  DFor_84_TTCAGC-C_ov
  modified_base 1: /mod_base="OTHER" /note="5'-phosphorylation"
cttcagctcgtcggcagcgtcagatgtgtataagagacag

SEQ ID NO: 1981 - DNA, 40 bp, Artificial Sequence
  DFor_85_CGTACT-C_ov
  modified_base 1: /mod_base="OTHER" /note="5'-phosphorylation"
ccgtacttcgtcggcagcgtcagatgtgtataagagacag

SEQ ID NO: 1982 - DNA, 40 bp, Artificial Sequence
  DFor_86_TCGGAT-C_ov
  modified_base 1: /mod_base="OTHER" /note="5'-phosphorylation"
ctcggattcgtcggcagcgtcagatgtgtataagagacag

SEQ ID NO: 1983 - DNA, 40 bp, Artificial Sequence
  DFor_87_TCCCAT-C_ov
  modified_base 1: /mod_base="OTHER" /note="5'-phosphorylation"
ctcccattcgtcggcagcgtcagatgtgtataagagacag

SEQ ID NO: 1984 - DNA, 40 bp, Artificial Sequence
  DFor_88_TTGCAC-C_ov
  modified_base 1: /mod_base="OTHER" /note="5'-phosphorylation"
cttgcactcgtcggcagcgtcagatgtgtataagagacag

SEQ ID NO: 1985 - DNA, 40 bp, Artificial Sequence
  DFor_89_TTCCTC-C_ov
  modified_base 1: /mod_base="OTHER" /note="5'-phosphorylation"
cttcctctcgtcggcagcgtcagatgtgtataagagacag

SEQ ID NO: 1986 - DNA, 40 bp, Artificial Sequence
  DFor_90_TACCTG-C_ov
  modified_base 1: /mod_base="OTHER" /note="5'-phosphorylation"
ctacctgtcgtcggcagcgtcagatgtgtataagagacag

SEQ ID NO: 1987 - DNA, 40 bp, Artificial Sequence
  DFor_91_AGAGTC-C_ov
  modified_base 1: /mod_base="OTHER" /note="5'-phosphorylation"
cagagtctcgtcggcagcgtcagatgtgtataagagacag

SEQ ID NO: 1988 - DNA, 40 bp, Artificial Sequence
  DFor_92_AGGACT-C_ov
  modified_base 1: /mod_base="OTHER" /note="5'-phosphorylation"
caggacttcgtcggcagcgtcagatgtgtataagagacag

SEQ ID NO: 1989 - DNA, 40 bp, Artificial Sequence
  DFor_93_GGCTTA-C_ov
  modified_base 1: /mod_base="OTHER" /note="5'-phosphorylation"
cggcttatcgtcggcagcgtcagatgtgtataagagacag

SEQ ID NO: 1990 - DNA, 40 bp, Artificial Sequence
  DFor_94_GGCTAT-C_ov
  modified_base 1: /mod_base="OTHER" /note="5'-phosphorylation"
cggctattcgtcggcagcgtcagatgtgtataagagacag

SEQ ID NO: 1991 - DNA, 40 bp, Artificial Sequence
  DFor_95_CGGTTA-C_ov
  modified_base 1: /mod_base="OTHER" /note="5'-phosphorylation"
ccggttatcgtcggcagcgtcagatgtgtataagagacag

SEQ ID NO: 1992 - DNA, 40 bp, Artificial Sequence
  DFor_96_TGGCAT-C_ov
  modified_base 1: /mod_base="OTHER" /note="5'-phosphorylation"
ctggcattcgtcggcagcgtcagatgtgtataagagacag

SEQ ID NO: 1993 - DNA, 53 bp, Artificial Sequence
  Universal_anchor_P7
  modified_base 1: /mod_base="OTHER" /note="5'-phosphorylation"
  modified_base 53: /mod_base="OTHER" /note="3'-biotinylation"
tctcgtatgccgtcttctgaaaaaaaaaaaaaaaaaaaaaaaaaaaaaaaaaa

SEQ ID NO: 1994 - DNA, 30 bp, Artificial Sequence
  AlphaFor57
gcatacgagattaggcaaaaagactcactg

SEQ ID NO: 1995 - DNA, 20 bp, Artificial Sequence
  AlphaRev57
cagtgagtctttttgcctaa

SEQ ID NO: 1996 - DNA, 36 bp, Artificial Sequence
  BetaFor20
  modified_base 11: /mod_base="OTHER" /note="deoxyinosine"
  modified_base 12: /mod_base="OTHER" /note="deoxyinosine"
  modified_base 13: /mod_base="OTHER" /note="deoxyinosine"
  modified_base 14: /mod_base="OTHER" /note="deoxyinosine"
  modified_base 15: /mod_base="OTHER" /note="deoxyinosine"
  modified_base 16: /mod_base="OTHER" /note="deoxyinosine"
gcatacgagannnnnnggacataaaaagactcactg

SEQ ID NO: 1997 - DNA, 20 bp, Artificial Sequence
  BetaRev20
cagtgagtctttttatgtcc

SEQ ID NO: 1998 - DNA, 60 bp, Artificial Sequence
  GammaFor20
  modified_base 11: /mod_base="OTHER" /note="deoxyinosine"
  modified_base 12: /mod_base="OTHER" /note="deoxyinosine"
  modified_base 13: /mod_base="OTHER" /note="deoxyinosine"
  modified_base 14: /mod_base="OTHER" /note="deoxyinosine"
  modified_base 15: /mod_base="OTHER" /note="deoxyinosine"
  modified_base 16: /mod_base="OTHER" /note="deoxyinosine"
  modified_base 17: /mod_base="OTHER" /note="deoxyinosine"
  modified_base 18: /mod_base="OTHER" /note="deoxyinosine"
  modified_base 19: /mod_base="OTHER" /note="deoxyinosine"
  modified_base 20: /mod_base="OTHER" /note="deoxyinosine"
  modified_base 21: /mod_base="OTHER" /note="deoxyinosine"
  modified_base 22: /mod_base="OTHER" /note="deoxyinosine"
gcatacgagannnnnnnnnnnnacatggactgtcgtcggcagcgtcagatgtgtataaga

SEQ ID NO: 1999 - DNA, 43 bp, Artificial Sequence
  GammaRev20
ctgtctcttatacacatctgacgctgccgacgacagtccatgt

SEQ ID NO: 2000 - DNA, 24 bp, Artificial Sequence
  i7-LongTruSeq
caagcagaagacggcatacgagat

SEQ ID NO: 2001 - DNA, 23 bp, Artificial Sequence
  pJET1_2For
cgactcactatagggagagcggc

SEQ ID NO: 2002 - DNA, 24 bp, Artificial Sequence
  pJET1_2Rev
aagaacatcgattttccatggcag

SEQ ID NO: 2003 - DNA, 54 bp, Artificial Sequence
  Universal_Attachment
  modified_base 1: /mod_base="OTHER" /note="double 5'biotinylation"
tttttttttttttttttttttttttttttttttttcagaagacggcatacgaga

SEQ ID NO: 2004 - DNA, 47 bp, Artificial Sequence
  Universal_dI6
  modified_base 24: /mod_base="OTHER" /note="deoxyinosine"
  modified_base 25: /mod_base="OTHER" /note="deoxyinosine"
  modified_base 26: /mod_base="OTHER" /note="deoxyinosine"
  modified_base 27: /mod_base="OTHER" /note="deoxyinosine"
  modified_base 28: /mod_base="OTHER" /note="deoxyinosine"
  modified_base 29: /mod_base="OTHER" /note="deoxyinosine"
gagctgaaggttgctcttcgtgcnnnnnntctcgtatgccgtcttct

SEQ ID NO: 2005 - DNA, 53 bp, Artificial Sequence
  Universal_dI12
  modified_base 24: /mod_base="OTHER" /note="deoxyinosine"
  modified_base 25: /mod_base="OTHER" /note="deoxyinosine"
  modified_base 26: /mod_base="OTHER" /note="deoxyinosine"
  modified_base 27: /mod_base="OTHER" /note="deoxyinosine"
  modified_base 28: /mod_base="OTHER" /note="deoxyinosine"
  modified_base 29: /mod_base="OTHER" /note="deoxyinosine"
  modified_base 30: /mod_base="OTHER" /note="deoxyinosine"
  modified_base 31: /mod_base="OTHER" /note="deoxyinosine"
  modified_base 32: /mod_base="OTHER" /note="deoxyinosine"
  modified_base 33: /mod_base="OTHER" /note="deoxyinosine"
  modified_base 34: /mod_base="OTHER" /note="deoxyinosine"
  modified_base 35: /mod_base="OTHER" /note="deoxyinosine"
gagctgaaggttgctcttcgtgcnnnnnnnnnnnntctcgtatgccgtcttct

SEQ ID NO: 2006 - DNA, 71 bp, Artificial Sequence
  Universal_dI18_Tn5B
  modified_base 35: /mod_base="OTHER" /note="deoxyinosine"
  modified_base 36: /mod_base="OTHER" /note="deoxyinosine"
  modified_base 37: /mod_base="OTHER" /note="deoxyinosine"
  modified_base 38: /mod_base="OTHER" /note="deoxyinosine"
  modified_base 39: /mod_base="OTHER" /note="deoxyinosine"
  modified_base 40: /mod_base="OTHER" /note="deoxyinosine"
  modified_base 41: /mod_base="OTHER" /note="deoxyinosine"
  modified_base 42: /mod_base="OTHER" /note="deoxyinosine"
  modified_base 43: /mod_base="OTHER" /note="deoxyinosine"
  modified_base 44: /mod_base="OTHER" /note="deoxyinosine"
  modified_base 45: /mod_base="OTHER" /note="deoxyinosine"
  modified_base 46: /mod_base="OTHER" /note="deoxyinosine"
  modified_base 47: /mod_base="OTHER" /note="deoxyinosine"
  modified_base 48: /mod_base="OTHER" /note="deoxyinosine"
  modified_base 49: /mod_base="OTHER" /note="deoxyinosine"
  modified_base 50: /mod_base="OTHER" /note="deoxyinosine"
  modified_base 51: /mod_base="OTHER" /note="deoxyinosine"
  modified_base 52: /mod_base="OTHER" /note="deoxyinosine"
ctgtctcttatacacatctccgagcccacgagacnnnnnnnnnnnnnnnnnntctcgtatgccgtcttctg

SEQ ID NO: 2007 - DNA, 28 bp, Artificial Sequence
  AFor_5_CAGGAA
  modified_base 28: /mod_base="OTHER" /note="deoxyuridine"
caggaagcacgaagagcaaccttcagcn

SEQ ID NO: 2008 - DNA, 28 bp, Artificial Sequence
  AFor_7_CCACAA
  modified_base 28: /mod_base="OTHER" /note="deoxyuridine"
ccacaagcacgaagagcaaccttcagcn

SEQ ID NO: 2009 - DNA, 28 bp, Artificial Sequence
  AFor_8_AGGCAA
  modified_base 28: /mod_base="OTHER" /note="deoxyuridine"
aggcaagcacgaagagcaaccttcagcn

SEQ ID NO: 2010 - DNA, 28 bp, Artificial Sequence
  AFor_12_CGAAGA
  modified_base 28: /mod_base="OTHER" /note="deoxyuridine"
cgaagagcacgaagagcaaccttcagcn

SEQ ID NO: 2011 - DNA, 28 bp, Artificial Sequence
  AFor_25_GTCTCA
  modified_base 28: /mod_base="OTHER" /note="deoxyuridine"
gtctcagcacgaagagcaaccttcagcn

SEQ ID NO: 2012 - DNA, 28 bp, Artificial Sequence
  AFor_29_CTCCTA
  modified_base 28: /mod_base="OTHER" /note="deoxyuridine"
ctcctagcacgaagagcaaccttcagcn

SEQ ID NO: 2013 - DNA, 28 bp, Artificial Sequence
  AFor_58_TAGTGC
  modified_base 28: /mod_base="OTHER" /note="deoxyuridine"
tagtgcgcacgaagagcaaccttcagcn

SEQ ID NO: 2014 - DNA, 28 bp, Artificial Sequence
  AFor_63_CATTCC
  modified_base 28: /mod_base="OTHER" /note="deoxyuridine"
cattccgcacgaagagcaaccttcagcn

SEQ ID NO: 2015 - DNA, 28 bp, Artificial Sequence
  AFor_68_AACCTC
  modified_base 28: /mod_base="OTHER" /note="deoxyuridine"
aacctcgcacgaagagcaaccttcagcn

SEQ ID NO: 2016 - DNA, 28 bp, Artificial Sequence
  AFor_75_ACGTGT
  modified_base 28: /mod_base="OTHER" /note="deoxyuridine"
acgtgtgcacgaagagcaaccttcagcn

SEQ ID NO: 2017 - DNA, 28 bp, Artificial Sequence
  AFor_91_AGTCAG
  modified_base 28: /mod_base="OTHER" /note="deoxyuridine"
agtcaggcacgaagagcaaccttcagcn

SEQ ID NO: 2018 - DNA, 28 bp, Artificial Sequence
  AFor_95_GTTACG
  modified_base 28: /mod_base="OTHER" /note="deoxyuridine"
gttacggcacgaagagcaaccttcagcn

SEQ ID NO: 2019 - DNA, 28 bp, Artificial Sequence
  BFor_6_GAAACC
  modified_base 28: /mod_base="OTHER" /note="deoxyuridine"
gaaaccgcacgaagagcaaccttcagcn

SEQ ID NO: 2020 - DNA, 28 bp, Artificial Sequence
  BFor_40_ACGAGA
  modified_base 28: /mod_base="OTHER" /note="deoxyuridine"
acgagagcacgaagagcaaccttcagcn

SEQ ID NO: 2021 - DNA, 28 bp, Artificial Sequence
  BFor_50_TTGAGC
  modified_base 28: /mod_base="OTHER" /note="deoxyuridine"
ttgagcgcacgaagagcaaccttcagcn

SEQ ID NO: 2022 - DNA, 28 bp, Artificial Sequence
  BFor_52_GACTAC
  modified_base 28: /mod_base="OTHER" /note="deoxyuridine"
gactacgcacgaagagcaaccttcagcn

SEQ ID NO: 2023 - DNA, 28 bp, Artificial Sequence
  BFor_68_CTCAAC
  modified_base 28: /mod_base="OTHER" /note="deoxyuridine"
ctcaacgcacgaagagcaaccttcagcn

SEQ ID NO: 2024 - DNA, 28 bp, Artificial Sequence
  BFor_73_GGTTCT
  modified_base 28: /mod_base="OTHER" /note="deoxyuridine"
ggttctgcacgaagagcaaccttcagcn

SEQ ID NO: 2025 - DNA, 28 bp, Artificial Sequence
  BFor_77_GCTACA
  modified_base 28: /mod_base="OTHER" /note="deoxyuridine"
gctacagcacgaagagcaaccttcagcn

SEQ ID NO: 2026 - DNA, 28 bp, Artificial Sequence
  BFor_78_GCTTAG
  modified_base 28: /mod_base="OTHER" /note="deoxyuridine"
gcttaggcacgaagagcaaccttcagcn

SEQ ID NO: 2027 - DNA, 28 bp, Artificial Sequence
  BFor_80_CCTATG
  modified_base 28: /mod_base="OTHER" /note="deoxyuridine"
cctatggcacgaagagcaaccttcagcn

SEQ ID NO: 2028 - DNA, 28 bp, Artificial Sequence
  BFor_82_TCTGCT
  modified_base 28: /mod_base="OTHER" /note="deoxyuridine"
tctgctgcacgaagagcaaccttcagcn

SEQ ID NO: 2029 - DNA, 28 bp, Artificial Sequence
  BFor_84_CTTCAG
  modified_base 28: /mod_base="OTHER" /note="deoxyuridine"
cttcaggcacgaagagcaaccttcagcn

SEQ ID NO: 2030 - DNA, 28 bp, Artificial Sequence
  BFor_85_TCGTAC
  modified_base 28: /mod_base="OTHER" /note="deoxyuridine"
tcgtacgcacgaagagcaaccttcagcn

SEQ ID NO: 2031 - DNA, 40 bp, Artificial Sequence
  CFor_4_AAGGAG
aaggaggtctcgtgggctcggagatgtgtataagagacag

SEQ ID NO: 2032 - DNA, 40 bp, Artificial Sequence
  CFor_5_AACAGG
aacagggtctcgtgggctcggagatgtgtataagagacag

SEQ ID NO: 2033 - DNA, 40 bp, Artificial Sequence
  CFor_37_GGTTGA
ggttgagtctcgtgggctcggagatgtgtataagagacag

SEQ ID NO: 2034 - DNA, 40 bp, Artificial Sequence
  CFor_42_CGTTAC
cgttacgtctcgtgggctcggagatgtgtataagagacag

SEQ ID NO: 2035 - DNA, 40 bp, Artificial Sequence
  CFor_49_TGTCGT
tgtcgtgtctcgtgggctcggagatgtgtataagagacag

SEQ ID NO: 2036 - DNA, 40 bp, Artificial Sequence
  CFor_70_ATGCCA
atgccagtctcgtgggctcggagatgtgtataagagacag

SEQ ID NO: 2037 - DNA, 40 bp, Artificial Sequence
  CFor_73_GTTCTG
gttctggtctcgtgggctcggagatgtgtataagagacag

SEQ ID NO: 2038 - DNA, 40 bp, Artificial Sequence
  CFor_87_TCCCAT
tcccatgtctcgtgggctcggagatgtgtataagagacag

SEQ ID NO: 2039 - DNA, 70 bp, Artificial Sequence; identical to SEQ ID NO: 1
  i5-Tn5ME-A
  modified_base 1: /mod_base="i" /note="5'biotinylation"

---

The invention claimed is:

1. A mixture of solid supports comprising at least one million solid supports, wherein each of said at least one million solid supports comprises multiple identical copies of a solid support-specific set of two transposons comprising a first transposon and a second transposon, wherein the first transposon and the second transposon each comprise a transfer strand having a 5' end and a 3' end and a non-transfer strand having a 5' end and a 3' end, wherein each solid support-specific set of two transposons comprises a DNA barcode tag that distinguishes the solid support from all other solid supports of the at least one million solid supports, wherein the first transposon of each set of two transposons comprises an adapter sequence A1 for sequencing library generation and the second transposon of each set of two transposons comprises an adapter sequence A2 for sequencing library generation, wherein (a) the adapter sequence A1 is on the transfer strand of the first transposon and the adapter sequence A2 is on the transfer strand of the second transposon or (b) the adapter sequence A1 is on the non-transfer strand of the first transposon and the adapter sequence A2 is on the non-transfer strand of the second transposon, wherein the first transposon and the second transposon of each set of two transposons are configured such that a transposase can bind to the 3'end of the transfer strand, wherein the non-transfer strand of the first transposon and the non-transfer strand of the second transposon of each set of two transposons are 5' phosphorylated, wherein the DNA barcode tag of each solid support of the at least one million solid supports consists of a first barcode sequence B1 comprised in the adapter sequence A1 and a second barcode sequence B2 comprised in the adapter sequence A2, wherein there are in total m different first barcode sequences B1 resulting in m different sequencing adapters A1 that differ only in the first barcode sequence B1 but are otherwise identical, wherein m is a positive integer, wherein the first barcode sequences B1 each comprise a first end and a second end, wherein there are in total n different second barcode sequences B2 resulting in n different sequencing adapters A2 that differ only in the second barcode sequence B2 but are otherwise identical, wherein n is a positive integer, wherein the second barcode sequences B2 each comprise a first end and a second end, wherein the m different first barcode sequences B1 all have an identical length selected from 8 to 25 nucleotides, and have an identical segmented barcode structure comprising z barcode segments, wherein z is 2, 3 or 4, wherein each of the z barcode segments has a length of 4 to 9 nucleotides, wherein the n different second barcode sequences B2 all have an identical length selected from 8 to 25 nucleotides, and have an identical segmented barcode structure comprising g barcode segments, wherein g is 2, 3 or 4, wherein each of the g barcode segments has a length of between 4 and 9 nucleotides, wherein the nucleic acid sequence of each first z barcode segment positioned closest to the first end of the first barcode sequences B1 is selected from a first set of $x_1$ predefined barcode nucleic acid sequences, wherein the nucleic acid sequence of each second z barcode segment positioned second closest to the first end of the first barcode sequences B1 is selected from a second set of $x_2$ predefined barcode nucleic acid sequences, wherein if the first barcode sequences B1 comprise 3 or 4 barcode segments then the nucleic acid sequence of each third z barcode segment positioned third closest to the first end of the first barcode sequences B1 is selected from a third set of $x_3$ predefined barcode nucleic acid sequences, wherein if the first barcode sequences B1 comprise 4 barcode segments then the nucleic acid sequence of each fourth z barcode segment positioned fourth closest to the first end of the first barcode sequences B1 is selected from a fourth set of $x_4$ predefined barcode nucleic acid sequences, wherein $x_1$, $x_2$, $x_3$, and $x_4$ are the number of different barcode nucleic acid sequences in each set of predefined barcode nucleic acid sequences, wherein the nucleic acid sequence of each first g barcode segment positioned closest to the first end of the second barcode sequence B2 is selected from a set of $k_1$ predefined barcode nucleic acid sequences, wherein the nucleic acid sequence of each second g barcode segment positioned second closest to the first end of the second barcode sequences B2 is selected from a second set of $k_2$ predefined barcode nucleic acid sequences, wherein if the first barcode sequences B2 comprise 3 or 4 barcode segments then the nucleic acid sequence of each third g barcode segment positioned third closest to the first end of the second barcode sequences B2 is selected from a third set of $k_3$ predefined barcode nucleic acid sequences, wherein if the first barcode sequences B2 comprise 4 barcode segments then the nucleic acid sequence of each fourth g barcode segment positioned fourth closest to the first end of the second barcode sequences B2 is selected from a fourth set of $k_4$ predefined barcode nucleic acid sequences, wherein $k_1$, $k_2$, $k_3$, and $k_4$ are the number of different barcode nucleic acid sequences in each set of predefined barcode nucleic acid sequences, wherein $$\prod_{i=1}^{z} x_i = m$$

and $$\prod_{i=1}^{g} k_i = n$$

wherein each predefined set of barcode nucleic acid sequences consists of at least two nucleic acid sequences that pairwise differ from each other in at least two nucleotide positions, and wherein $m \times n \geq 1 \times 10^6$.

2. The mixture of solid supports of claim 1, wherein adjacent barcode segments of the z barcode segments of the barcode sequence B1 are connected directly or by a linker sequence(s) L1, and wherein adjacent barcode segments of the g barcode segments of the barcode sequence B2 are connected directly or by a linker sequence(s) L2, wherein the linker sequences L1 and L2 are of a length of one or two nucleotides.

3. The mixture of solid supports of claim 1, wherein adjacent barcode segments of the z barcode segments of the barcode sequence B1 do not have a linker sequence(s) between them, and wherein adjacent barcode segments of the g barcode segments of the barcode sequence B2 do not have a linker sequence(s) between them.

4. The mixture of solid supports of claim 1, wherein the adapter sequence A1 is configured to comprise the barcode sequence B1 in a first sample indexing position, wherein the adapter sequence A2 is configured to comprise the barcode sequence B2 in a second sample indexing position, wherein the first and the second indexing position are different.

5. The mixture of solid supports of claim 2, wherein barcode sequences B1 and barcode sequences B2 both have 2 barcode segments, wherein $x_1$, $x_2$, $k_1$ and $k_2$ are 84 to 96 different barcode nucleic acid sequences, wherein the length of the barcode sequences B1 and the length of the barcode sequences B2 are 13 nucleotides, and wherein the linker sequences L1 and L2 have a length of 1 nucleotide.

6. The mixture of solid supports of claim 1, wherein the solid supports have a hydrophobic surface and/or wherein the solid supports are beads.

7. The mixture of solid supports of claim 1, wherein one strand of each first and each second transposon consists only of a transposase recognition sequence.

8. The mixture of solid supports of claim 1, wherein on the surface of each solid support of said at least one million solid supports:

transposase is bound to the first and second transposons; and a plurality of heterodimeric transposome complexes each comprising a first transposome comprising the first transposon and a second transposome comprising the second transposon exist.

9. A kit comprising:

a) the mixture of solid supports of claim 1; and b) transposase.

10. A method for tagmentation of a target DNA sample comprising individual contiguous target DNA molecules on a solid support, wherein each individual contiguous target DNA molecule comprises a first strand having a 5' end and a 3' end and a second strand having a 5' end and a 3' end, wherein the method comprises combining a mixture of solid supports of claim 8 or a subpool thereof comprising at least $10^5$ solid supports with different DNA barcode tags and the target DNA sample in a single reaction vessel; and incubating the mixture to fragment the individual contiguous target DNA molecules on different single solid supports, wherein the tagmentation on each of the different single solid supports forms fragments of an individual target DNA molecule, wherein the 5' end of the first strand of each individual target DNA molecule fragments is ligated with the 3' end of the transfer-strand of the first transposon through transposition and the 5' end of the second strand of each individual target DNA molecule fragment is ligated with the 3' end of the transfer-strand of the second transposon.

11. A method for generating a DNA library for sequencing from a target DNA sample comprising individual contiguous target DNA molecules, wherein each individual contiguous target DNA molecule comprises a first strand having a 5' end and a 3' end and a second strand having a 5' end and a 3' end, said DNA library containing contiguity information of the DNA molecules comprised in the target DNA sample, wherein said method comprises:

a) performing on-bead tagmentation of the target DNA sample in a single reaction vessel by combining a mixture of solid supports of claim 8 or a subpool thereof comprising at least $10^5$ solid supports with different DNA barcode tags and the target DNA sample in a single reaction vessel;

and incubating the mixture to fragment the individual contiguous target DNA molecules on different single solid supports, wherein the on-bead tagmentation on each of the single solid supports forms fragments of the individual target DNA molecule, wherein the 5' end of the first strand of the individual target DNA molecule fragments is ligated with the 3' end of the transfer-strand of the first transposon through transposition and the 5' end of the second strand of the individual target DNA molecule fragment is ligated with the 3' end of the transfer-strand of the second transposon, wherein the on-bead tagmentation results in target DNA molecule fragments having an average length of 300 base pairs (bp) to 600 bp;

(b) washing the solid supports;

(c) removing the transposase from the solid supports;

(d) extending the 3' ends of the first strand of the target DNA molecule fragments and the 3' ends of the second strand of the target DNA molecule fragments to produce linkages between the non-transfer strands of the first and second transposons and the target DNA molecule fragments; and (e) performing a PCR reaction amplifying the barcode tagged target DNA molecule fragments.

12. A DNA sequencing method for determining contiguous sequence information from a target DNA sample, comprising:

a) generating a DNA sequencing library according to the method of claim 11;

b) performing DNA sequencing of the barcode tagged target DNA molecule fragments, wherein sequence information of the target DNA molecule fragments and the barcode sequences B1 and B2 appended to the target DNA molecule fragments are determined; and c) determining which target DNA molecule fragments are derived from which target DNA molecule, wherein step c) comprises:

detecting the sequences of the z barcode segments of the barcode sequences B1 and the g barcode segments of the barcode sequences B2;

performing error detection and correction individually on each of the z barcode segments and the g barcode segments, thereby generating error corrected barcode segment sequences;

determining the DNA barcode tags based on the error corrected barcode segment sequences and assigning the target DNA molecule fragments having identical DNA barcode tags to be comprised in a contiguous target DNA molecule.

13. A computer program product or a computer-readable medium comprising instructions which, when executed by a computer, cause the computer to carry out the steps as defined in step c) of claim 12 on DNA sequencing data as obtainable by steps a) and b) of claim 12.

14. A method for producing a mixture of beads as defined in claim 6, comprising: assembling the multiple identical copies of the solid-support specific set of two transposons on the at least 1 million solid supports by a stepwise split-and-pool ligation assembly of a set of DNA molecules, wherein said set of DNA molecules consists of first set of double-stranded DNA molecules for assembling the first transposons and a second set of double stranded DNA molecules for assembling the second transposons, wherein the first set of DNA molecules consists of z subsets of DNA molecules, wherein z is 2, 3 or 4, wherein a first subset A of the z subsets of the first set of DNA molecules consists of DNA molecules that each comprise a common solid-support attachment site on the first end and one of the x1 nucleic acid sequences for the first barcode segment of the z barcode segments of the barcode sequences B1 and a single stranded overhang of one or two nucleotides on an opposite second end, wherein a second subset C of the z subsets of the first set of DNA molecules consists of DNA molecules that each comprise one xz last barcode segments of the barcodes sequences B1 and a single stranded overhang of one or two nucleotides that is reverse complementary to the overhang of the DNA molecules of the subset A or second to the last barcode segments of the barcode sequence B1 on one end and a transposase recognition site on the opposite second end, wherein, when z≥3, other subsets of the z subsets of DNA molecules consist of the x2 to xz−1 sequences having on both ends single stranded overhangs being reverse complementary with the overhangs of the adjacent barcode segments, respectively, wherein the second set of DNA molecules consists of g subsets of DNA molecules, wherein g is 2, 3 or 4, wherein a first subset B of the g subsets of the second set of DNA molecules consists of DNA molecules that each comprise a common solid-support attachment site on the first end and one of the $k_1$ nucleic acid sequences for the first barcode segment of the g barcode segments of the barcode sequences B2 and a single stranded overhang of one or two nucleotides on an opposite second end, wherein a second subset D of the g subsets of the second set of DNA molecules consists of DNA molecules that each comprise one $k_g$ last barcode segments of the barcodes sequences B2 and a single stranded overhang of one or two nucleotides that is reverse complementary to the overhang of the DNA molecules of the subset B or second to the last barcode segments of the barcode sequence B2 on one end and a transposase recognition site on the opposite second end, wherein, when g>3, other subsets of the g subsets of DNA molecules consist of $k_2$ to $k_g$-i sequences having on both ends single stranded overhangs being reverse complementary with the overhangs of the adjacent barcode segments, respectively, wherein at least one ligation in the split-and-pool assembly is catalyzed by a TA-ligase.

15. The method of claim 14, wherein the attachment to the solid supports is mediated by one strand of the transposons, and wherein the method further comprises: (i) removing a other strand of the transposons wherein said removing comprises melting in the presence of a sodium hydroxide solution, wherein the sodium hydroxide concentration is between 0.1 M and 0.15 M; (ii) washing the solid supports of step (i); and (iii) hybridizing a 5' phosphorylated single-stranded oligonucleotide consisting of a reverse complementary sequence of the transposase recognition sequence to the single stranded sequences so as to generate transposons having a transfer and non-transfer strand.

16. A method for producing solid supports with attached solid support specific segmented DNA barcode sequences, wherein the barcode segments of the barcode sequences are directly linked to each other, and wherein said method comprises: a) providing solid supports in a plurality of reaction compartments, wherein each solid support has multiple identical copies of a single stranded DNA oligonucleotide selected from a predefined set of single stranded DNA oligonucleotides A attached thereto, wherein the oligonucleotides are attached to a solid support via one end, the end being 5' or 3' end for all oligonucleotides, and wherein the oligonucleotides have a free second end that is formed by a barcode segment A; b) ligating in each of the reaction compartments a polynucleotide selected from a set of predefined polynucleotides B to the free end of the solid support-attached single-stranded oligonucleotides, wherein each of the polynucleotides of the set B comprises a double stranded section and a single stranded section, wherein the single stranded section is reverse complementary to the free end of the solid support-attached single-stranded oligonucleotides of set A and comprises universal nucleotides at the positions being reverse complementary to the barcode segment A, wherein the single stranded section comprises 6 to 20 reverse complementary nucleotides other than the universal nucleotides, wherein the double stranded section comprises a barcode segment B positioned directly at the end facing the single stranded section, wherein the polynucleotides of the set B differ in the sequence of the barcode segment B; and c) removing the strands originating from the single stranded section from the solid supports by exonuclease digestion so as to generate on the solid supports single stranded oligonucleotides comprising a barcode segment A and a barcode segment B directly linked to each other.

17. The method of claim 16, wherein the method further comprises:

h) distributing the produced solid supports into a plurality of different reaction compartments; and i) attaching to each of the solid supports in each of the reaction compartments multiple copies of a second barcoded polynucleotide, wherein in each of the plurality of reaction compartments a differently barcoded polynucleotide is attached.

\* \* \* \* \*